(12) United States Patent
Frias et al.

(10) Patent No.: US 10,358,664 B2
(45) Date of Patent: Jul. 23, 2019

(54) MUTANT HOST CELLS FOR THE PRODUCTION OF 3-HYDROXYPROPIONIC ACID

(71) Applicant: Novozymes A/S, Bagsvaerd (DK)

(72) Inventors: Janice Frias, New Brighton, MN (US); Guillaume Barbier, Davis, CA (US)

(73) Assignee: Novozymes A/S, Bagsvaerd (DK)

( * ) Notice: Subject to any disclaimer, the term of this patent is extended or adjusted under 35 U.S.C. 154(b) by 14 days.

(21) Appl. No.: 15/553,241

(22) PCT Filed: Feb. 25, 2016

(86) PCT No.: PCT/US2016/019629
§ 371 (c)(1),
(2) Date: Aug. 24, 2017

(87) PCT Pub. No.: WO2016/138303
PCT Pub. Date: Sep. 1, 2016

(65) Prior Publication Data
US 2018/0237809 A1    Aug. 23, 2018

Related U.S. Application Data

(60) Provisional application No. 62/126,377, filed on Feb. 27, 2015.

(51) Int. Cl.
| *C12N 1/19* | (2006.01) |
| *C12N 9/04* | (2006.01) |
| *C12P 7/42* | (2006.01) |
| *C12P 7/40* | (2006.01) |

(52) U.S. Cl.
CPC .............. *C12P 7/42* (2013.01); *C12N 9/0006* (2013.01); *C12Y 101/01081* (2013.01)

(58) Field of Classification Search
None
See application file for complete search history.

(56) References Cited

U.S. PATENT DOCUMENTS

2012/0329110 A1    12/2012 Kim et al.

FOREIGN PATENT DOCUMENTS

| JP | 2013071898 | 4/2013 |
| WO | 2001016346 A1 | 3/2001 |
| WO | 2002042418 A2 | 5/2002 |
| WO | 2007032792 A2 | 3/2007 |
| WO | 2012074818 A2 | 6/2012 |
| WO | 2014085330 A1 | 6/2014 |

OTHER PUBLICATIONS

Seffernick et al., J. Bacteriol. 183:2405-2410, 2001 (Year: 2001).*
UniProt Database Accession No. A0A2U9R319, Dec. 2018, 1 page (Year: 2018).*
Anonymous, Database Uniprot No. A0A099P5X7 (Jan. 7, 2015).
Marti-Renom et al., Annu. Rev. Biophys. Biomol. Struct. 2000, 29, 291-325.

* cited by examiner

*Primary Examiner* — David Steadman
(74) *Attorney, Agent, or Firm* — Eric J. Fechter

(57) ABSTRACT

Provided herein are recombinant host cells having an active 3-Hydroxypropionic Acid (3-HP) pathway wherein the host cells comprise a disruption to an endogenous gene that encodes for a pyruvate reductase. Also described are methods of making the host cells, and methods using the cells to produce 3-HP and derivatives of 3-HP (e.g., acrylic acid).

18 Claims, 6 Drawing Sheets
Specification includes a Sequence Listing.

US 10,358,664 B2

MUTANT HOST CELLS FOR THE PRODUCTION OF 3-HYDROXYPROPIONIC ACID

CROSS-REFERENCE TO RELATED APPLICATIONS

This application is a 35 U.S.C. 371 national application of PCT/US2016/019629, filed Feb. 25, 2016, which claims priority benefit of U.S. provisional application Ser. No. 62/126,377, filed on Feb. 27, 2015. The contents of these applications are fully incorporated herein by reference.

REFERENCE TO A SEQUENCE LISTING

This application contains a Sequence Listing in computer readable form, which is incorporated herein by reference.

BACKGROUND 3-hydroxypropionic acid (3-HP) is a three carbon carboxylic acid identified by the U.S. Department of Energy as one of the top 12 high-potential building block chemicals that can be made by fermentation. Alternative names for 3-HP, which is an isomer of lactic (2-hydroxypropionic) acid, include ethylene lactic acid and 3-hydroxypropionate. 3-HP is an attractive renewable platform chemical, with 100% theoretical yield from glucose, multiple functional groups that allow it to participate in a variety of chemical reactions, and low toxicity. 3-HP can be used as a substrate to form several commodity chemicals, such as 1,3-propanediol, malonic acid, acrylamide, and acrylic acid. Acrylic acid is a large-volume chemical (>7 billion lbs/year) used to make acrylate esters and superabsorbent polymers, and is currently derived from catalytic oxidation of propylene. Fermentative production of 3-HP would provide a sustainable alternative to petrochemicals as the feedstock for these commercially-significant chemicals, thus reducing energy consumption, dependence on foreign oil supplies, and the production of greenhouse gases.

Unlike lactic acid, 3-HP is not a major end product of any pathway known in nature, being found in only trace amounts in some bacteria and fungi. Thus, a greater deal of genetic engineering is necessary to generate yeast that produce 3-HP. Several metabolic routes have been described to produce 3-HP (see WO01/16346; WO02/042418; WO2012/074818). However, there is still a need in the art to further improve 3-HP production in a more cost-effective manner on an industrial scale. In particular, there is a need to improve 3-HP production yields by minimizing the formation of unwanted byproducts.

SUMMARY

Described herein are microbial strains comprising modifications related to a pyruvate reductase gene.

In one aspect is a recombinant host cell having an active 3-HP pathway, wherein the cell comprises a disruption to an endogenous gene that encodes for a pyruvate reductase (e.g., the pyruvate reductase of SEQ ID NO: 205). In some embodiments, the host cell produces less pyruvate reductase and/or D-lactate compared to the parent strain that lacks disruption of the endogenous gene encoding for the pyruvate reductase, when cultivated under identical conditions. In some embodiments, the endogenous gene encoding the pyruvate reductase is inactivated.

In some embodiments, the recombinant cell is a bacterial or fungal cell. In some embodiments, the recombinant cell is a yeast cell such as an *Issatchenkia*, *Candida*, *Kluyveromyces*, *Pichia*, *Schizosaccharomyces*, *Torulaspora*, *Zygosaccharomyces*, or *Saccharomyces* yeast cell. In some embodiments, the recombinant cell is a 3-HP-resistant yeast cell. In some embodiments, the recombinant cell is unable to ferment pentose sugars.

In some embodiments, the recombinant cell comprises one or more (e.g., two, several) heterologous polynucleotides selected from a heterologous polynucleotide encoding a pyruvate dehydrogenase (PDH), a heterologous polynucleotide encoding an acetyl-CoA carboxylase (ACC), a heterologous polynucleotide encoding a malonyl-CoA reductase, and a heterologous polynucleotide encoding a 3-HP dehydrogenase (3-HPDH).

In some embodiments, the recombinant cell comprises one or more (e.g., two, several) heterologous polynucleotides selected from a heterologous polynucleotide encoding a PEP carboxylase (PPC), a heterologous polynucleotide encoding a pyruvate carboxylase (PYC), a heterologous polynucleotide encoding an aspartate aminotransferase (AAT), a heterologous polynucleotide encoding an aspartate 1-decarboxylase (ADC), a heterologous polynucleotide encoding a β-alanine aminotransferase (BAAT) or aminobutyrate aminotransferase (gabT), and a heterologous polynucleotide encoding a 3-HP dehydrogenase (3-HPDH). In some embodiments, the recombinant cell comprises a heterologous polynucleotide encoding an aspartate 1-decarboxylase (ADC).

Also described are methods method for obtaining a recombinant host cells comprising: (a) cultivating a parent strain; (b)(i) transforming the parent strain with one or more 3-HP pathway gene(s) to provide an active 3-HP pathway in the parent strain of (a); (b)(ii) disrupting an endogenous gene encoding a pyruvate reductase in the parent strain of (a); and (c) isolating the mutant strain resulting from (b)(i) and (b)(ii).

Also described are methods of producing 3-HP and related compounds. In one aspect is a method of producing 3-HP, comprising: (a) cultivating a recombinant cell described herein in a medium under suitable conditions to produce 3-HP; and (b) recovering the 3-HP. In another aspect is a method of producing acrylic acid or a salt thereof, comprising: (a) cultivating a recombinant cell described herein in a medium under suitable conditions to produce 3-HP; (b) recovering the 3-HP; (c) dehydrating the 3-HP under suitable conditions to produce acrylic acid or a salt thereof; and (d) recovering the acrylic acid or salt thereof.

DEFINITIONS

Figure 1:
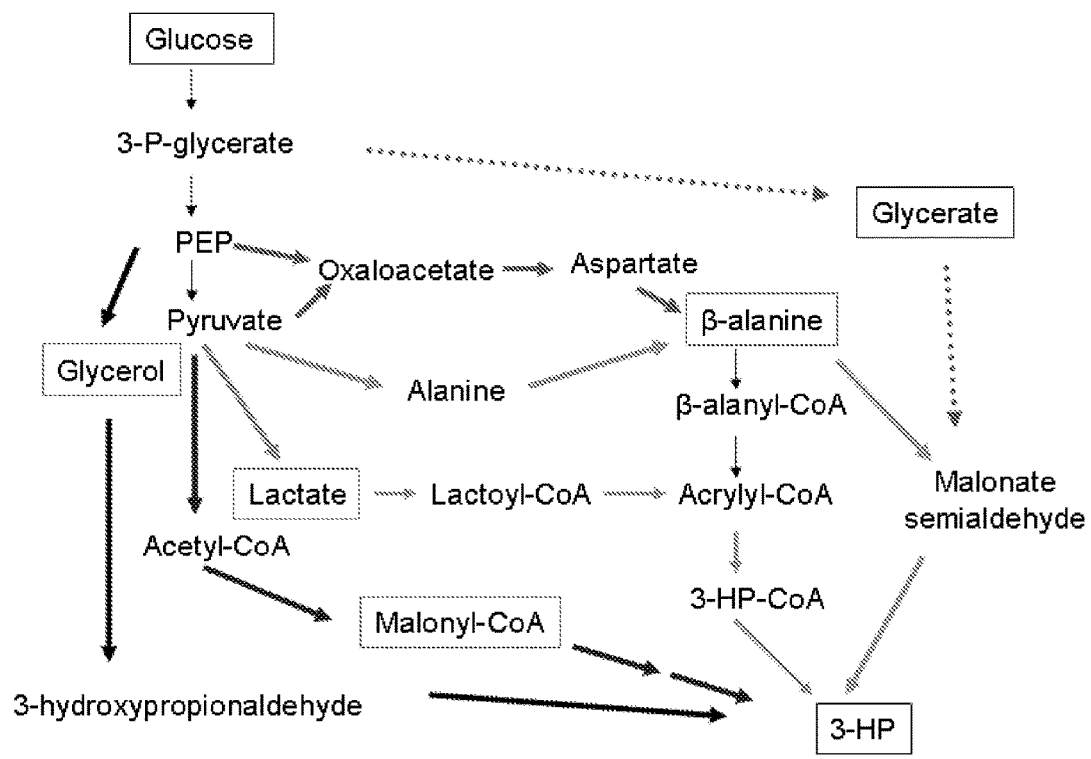
FIG. 1 shows a summary of select 3-HP pathways from glucose.

3-HP: The term "3-HP" includes salt and acid forms of "3-hydroxypropionic acid" unless stated otherwise from the context in which it is used.

Abbreviations: 3-HPA, 3-hydroxypropionaldehyde; 3-HPDH, 3-hydroxypropionic acid dehydrogenase; AAM, alanine 2,3-aminomutase; AAT, aspartate aminotransferase; ACC, acetyl-CoA carboxylase; ADC, aspartate 1-decarboxylase; AKG, alpha-ketoglutarate; ALD, aldehyde dehydrogenase; BAAT, β-alanine aminotransferase; BCKA, branched-chain alpha-keto acid decarboxylase; bp, base pairs; CYB2, L-(+)-lactate-cytochrome c oxidoreductase; CYC, iso-2-cytochrome c; EMS, ethane methyl sulfonase; ENO, enolase; gabT, 4-aminobutyrate aminotransferase; GAPDH, glyceraldehyde-3-phosphate dehydrogenase 3; GPD, glycerol 3-phosphate dehydrogenase; GPP, glycerol 3-phosphate phosphatase; HIBADH, 3-hydroxyisobutyrate dehydrogenase; IPDA, indolepyruvate decarboxylase; KGD, alpha-ketoglutarate decarboxylase; LDH, lactate dehydrogenase; MAE, malic enzyme; MDHB, malate dehydrogenase B; OAA, oxaloacetate; PCK, phosphoenolpyruvate carboxykinase; PDC, pyruvate decarboxylase; PDH, pyruvate dehydrogenase; PEP, phosphoenolpyruvate; PGK, phosphoglycerate kinase; PPC, phosphoenolpyruvate carboxylase; PYC, pyruvate carboxylase; RKI, ribose 5-phosphate ketol-isomerase; TAL, transaldolase; TEF1, translation elongation factor-1; TEF2, translation elongation factor-2; TKL, transketolase; XDH, xylitol dehydrogenase; XR, xylose reductase; YP, yeast extract/peptone.

Active 3-HP pathway: As used herein, a host cell having an "active 3-HP pathway" produces active enzymes necessary to catalyze each reaction of a metabolic pathway in a sufficient amount to produce 3-HP from a fermentable sugar, and therefore is capable of producing 3-HP in measurable yields when cultivated under fermentation conditions in the presence of at least one fermentable sugar. A host cell having an active 3-HP pathway comprises one or more 3-HP pathway genes. A "3-HP pathway gene" as used herein refers to a gene that encodes an enzyme involved in an active 3-HP pathway.

The active enzymes necessary to catalyze each reaction in an active 3-HP pathway may result from activities of endogenous gene expression, activities of heterologous gene expression, or from a combination of activities of endogenous and heterologous gene expression, as described in more detail herein.

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Coding sequence: The term "coding sequence" or "coding region" means a polynucleotide sequence, which specifies the amino acid sequence of a polypeptide. The boundaries of the coding sequence are generally determined by an open reading frame, which usually begins with the ATG start codon or alternative start codons such as GTG and TTG and ends with a stop codon such as TAA, TAG, and TGA. The coding sequence may be a sequence of genomic DNA, cDNA, a synthetic polynucleotide, and/or a recombinant polynucleotide.

Control sequence: The term "control sequence" means a nucleic acid sequence necessary for polypeptide expression. Control sequences may be native or foreign to the polynucleotide encoding the polypeptide, and native or foreign to each other. Such control sequences include, but are not limited to, a leader sequence, polyadenylation sequence, propeptide sequence, promoter sequence, signal peptide sequence, and transcription terminator sequence. The control sequences may be provided with linkers for the purpose of introducing specific restriction sites facilitating ligation of the control sequences with the coding region of the polynucleotide encoding a polypeptide.

Disruption: The term "disruption" means that a coding region and/or control sequence of a referenced gene is partially or entirely modified (such as by deletion, insertion, and/or substitution of one or more nucleotides) resulting in the absence (inactivation) or decrease in expression, and/or the absence or decrease of enzyme activity of the encoded polypeptide. The effects of disruption can be measured using techniques known in the art such as detecting the absence or decrease of enzyme activity using from cell-free extract measurements referenced herein; or by the absence or decrease of corresponding mRNA (e.g., at least 25% decrease, at least 50% decrease, at least 60% decrease, at least 70% decrease, at least 80% decrease, or at least 90% decrease); the absence or decrease in the amount of corresponding polypeptide having enzyme activity (e.g., at least 25% decrease, at least 50% decrease, at least 60% decrease, at least 70% decrease, at least 80% decrease, or at least 90% decrease); or the absence or decrease of the specific activity of the corresponding polypeptide having enzyme activity (e.g., at least 25% decrease, at least 50% decrease, at least 60% decrease, at least 70% decrease, at least 80% decrease, or at least 90% decrease). Disruptions of a particular gene of interest can be generated by methods known in the art, e.g., by directed homologous recombination (see *Methods in Yeast Genetics* (1997 edition), Adams, Gottschling, Kaiser, and Stems, Cold Spring Harbor Press (1998)).

Endogenous gene: The term "endogenous gene" means a gene that is native to the referenced host cell. "Endogenous gene expression" means expression of an endogenous gene.

Expression: The term "expression" includes any step involved in the production of the polypeptide including, but not limited to, transcription, post-transcriptional modification, translation, post-translational modification, and secretion. Expression can be measured—for example, to detect increased expression—by techniques known in the art, such as measuring levels of mRNA and/or translated polypeptide.

Expression vector: The term "expression vector" means a linear or circular DNA molecule that comprises a polynucleotide encoding a polypeptide and is operably linked to control sequences, wherein the control sequences provide for expression of the polynucleotide encoding the polypeptide. At a minimum, the expression vector comprises a promoter sequence, and transcriptional and translational stop signal sequences.

Fermentable medium: The term "fermentable medium" or "fermentation medium" refers to a medium comprising one or more (e.g., two, several) sugars, such as glucose, fructose, sucrose, cellobiose, xylose, xylulose, arabinose, mannose, galactose, and/or soluble oligosaccharides, wherein the medium is capable, in part, of being converted (fermented) by a host cell into a desired product, such as 3-HP. In some instances, the fermentation medium is derived from a natural source, such as sugar cane, starch, or cellulose, and may be the result of pretreating the source by enzymatic hydrolysis (saccharification).

Heterologous polynucleotide: The term "heterologous polynucleotide" is defined herein as a polynucleotide that is not native to the host cell; a native polynucleotide in which structural modifications have been made to the coding region; a native polynucleotide whose expression is quantitatively altered as a result of a manipulation of the DNA by recombinant DNA techniques, e.g., a different (foreign) promoter; or a native polynucleotide in a host cell having one or more extra copies of the polynucleotide to quantitatively alter expression. A "heterologous gene" is a gene comprising a heterologous polynucleotide.

Host cell: The term "host cell" means any cell type that is susceptible to transformation, transfection, transduction, and the like with a nucleic acid construct or expression vector. The term "host cell" encompasses any progeny of a parent cell that is not identical to the parent cell due to mutations that occur during replication. The term "recombinant cell" is defined herein as a non-naturally occurring host cell comprising one or more (e.g., two, several) heterologous polynucleotides. The host cell may be a mutant strain described herein, or further disrupted to provide a mutant strain described herein.

Hybridization conditions: The term "very low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 0.2×SSC, 0.2% SDS at 45° C.

The term "low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 0.2×SSC, 0.2% SDS at 50° C.

The term "medium stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 0.2×SSC, 0.2% SDS at 55° C.

The term "medium-high stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 0.2×SSC, 0.2% SDS at 60° C.

The term "high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.2×SSC, 0.2% SDS at 65° C.

The term "very high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.2×SSC, 0.2% SDS at 70° C.

Isolated: The term "isolated" means a substance in a form or environment that does not occur in nature. Non-limiting examples of isolated substances include (1) any non-naturally occurring substance, (2) any substance including, but not limited to, any host cell, enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated.

Mutant: The term "mutant" means the resulting strain after one or more disruptions are made to a parent strain.

Nucleic acid construct: The term "nucleic acid construct" means a polynucleotide comprises one or more (e.g., two, several) control sequences. The polynucleotide may be single-stranded or double-stranded, and may be isolated from a naturally occurring gene, modified to contain segments of nucleic acids in a manner that would not otherwise exist in nature, or synthetic.

Operably linked: The term "operably linked" means a configuration in which a control sequence is placed at an appropriate position relative to the coding sequence of a polynucleotide such that the control sequence directs expression of the coding sequence.

Parent: The term "parent" or "parent strain" means a strain to which a disruption is made to produce a mutant strain described herein. The parent may be a naturally occurring (wild-type) or previously modified strain (e.g., a strain modified to comprise an active 3-HP pathway).

Pyruvate reductase: The term "pyruvate reductase" means a polypeptide having the referenced sequence that may contribute to increased levels of D-lactate in a host cell expressing the polypeptide, e.g., by catalyzing the reduction of pyruvate to D-lactate in the presence of a NAD(H) or NADP(H) cofactor. In any aspect described herein, the referenced pyruvate reductase may have pyruvate reductase activity. Pyruvate reductase activity can be determined according to pyruvate reductase assay described in the Examples. In one aspect, the pyruvate reductase of the present invention has at least 20%, e.g., at least 40%, at least 50%, at least 60%, at least 70%, at least 80%, at least 90%, at least 95%, or at least 100% of the pyruvate reductase of SEQ ID NO: 205.

Sequence Identity: The relatedness between two amino acid sequences or between two nucleotide sequences is described by the parameter "sequence identity".

For purposes described herein, the degree of sequence identity between two amino acid sequences is determined using the Needleman-Wunsch algorithm (Needleman and Wunsch, J. Mol. Biol. 1970, 48, 443-453) as implemented in the Needle program of the EMBOSS package (EMBOSS: The European Molecular Biology Open Software Suite, Rice et al., Trends Genet 2000, 16, 276-277), preferably version 3.0.0 or later. The optional parameters used are gap open penalty of 10, gap extension penalty of 0.5, and the EBLOSUM62 (EMBOSS version of BLOSUM62) substitution matrix. The output of Needle labeled "longest identity" (obtained using the -nobrief option) is used as the percent identity and is calculated as follows:

(Identical Residues×100)/(Length of the Referenced Sequence−Total Number of Gaps in Alignment)

For purposes described herein, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. The optional parameters used are gap open penalty of 10, gap extension penalty of 0.5, and the EDNAFULL (EMBOSS version of NCBI NUC4.4) substitution matrix. The output of Needle labeled "longest identity" (obtained using the -nobrief option) is used as the percent identity and is calculated as follows:

(Identical Deoxyribonucleotides×100)/(Length of Referenced Sequence−Total Number of Gaps in Alignment)

Volumetric productivity: The term "volumetric productivity" refers to the amount of referenced product produced (e.g., the amount of 3-HP produced) per volume of the system used (e.g., the total volume of media and contents therein) per unit of time.

Reference to "about" a value or parameter herein includes aspects that are directed to that value or parameter per se. For example, description referring to "about X" includes the aspect "X". When used in combination with measured values, "about" includes a range that encompasses at least the uncertainty associated with the method of measuring the particular value, and can include a range of plus or minus two standard deviations around the stated value.

As used herein and in the appended claims, the singular forms "a," "or," and "the" include plural referents unless the context clearly dictates otherwise. It is understood that the aspects described herein include "consisting" and/or "consisting essentially of" aspects.

Unless defined otherwise or clearly indicated by context, all technical and scientific terms used herein have the same meaning as commonly understood by one of ordinary skill in the art.

DETAILED DESCRIPTION

Described herein, inter alia, are microbial strains comprising modifications related to a pyruvate reductase gene. The Applicant has found an endogenous gene comprising the sequence of SEQ ID NO: 204 that encodes for a pyruvate reductase of SEQ ID NO: 205, and that disruption of this gene results in decreased production of D-lactate in the mutant compared to the parent strain when cultivated under identical conditions. Thus, the skilled artisan is provided with a means of producing D-lactate (by overexpression of the pyruvate reductase), or decreasing undesirable D-lactate contaminant to improve carbon yield in a fermentation host cell (by disrupting the pyruvate reductase gene).

Pyruvate Reductase Expression

In one aspect is a recombinant host cell, comprising a heterologous polynucleotide encoding a pyruvate reductase. The pyruvate reductase can be any pyruvate reductase described herein that is suitable for the host cells and their methods of use, such as the pyruvate reductase of SEQ ID NO: 205, or variants thereof that retain pyruvate reductase activity (such as artificial variants or natural variants from other species).

In one embodiment, the heterologous polynucleotide encodes a pyruvate reductase that comprises or consists of the amino acid sequence of SEQ ID NO: 205. In some aspects, the pyruvate reductase has at least 20%, e.g., at least 40%, at least 50%, at least 60%, at least 70%, at least 80%, at least 90%, at least 95%, at least 96%, at least 97%, at least 98%, at least 99%, or 100% of the pyruvate reductase activity of SEQ ID NO: 205, under the same conditions.

In another embodiment, the heterologous polynucleotide encodes a fragment of a polypeptide of SEQ ID NO: 205, wherein the fragment has pyruvate reductase activity. In one embodiment, the number of amino acid residues in the fragment is at least 75%, e.g., at least 80%, 85%, 90%, or 95% of SEQ ID NO: 205.

The heterologous polynucleotide may also encode a variant of the pyruvate reductase of SEQ ID NO: 205. In one embodiment, the pyruvate reductase has at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to SEQ ID NO: 205. In one embodiment, the pyruvate reductase sequence differs by no more than ten amino acids, e.g., by no more than five amino acids, by no more than four amino acids, by no more than three amino acids, by no more than two amino acids, or by one amino acid from SEQ ID NO: 205. In one embodiment, the pyruvate reductase comprises or consists of the amino acid sequence of SEQ ID NO: 205, or an allelic variant, or a fragment thereof having pyruvate reductase activity. In one embodiment, the pyruvate reductase has an amino acid substitution, deletion, and/or insertion of one or more (e.g., two, several) amino acids of SEQ ID NO: 205. In some embodiments, the total number of amino acid substitutions, deletions and/or insertions is not more than 10, e.g., not more than 9, 8, 7, 6, 5, 4, 3, 2, or 1.

The amino acid changes are generally of a minor nature, that is conservative amino acid substitutions or insertions that do not significantly affect the folding and/or activity of the protein; small deletions, typically of one to about 30 amino acids; small amino-terminal or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

Examples of conservative substitutions are within the group of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, The Proteins, Academic Press, New York. The most commonly occurring exchanges are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the pyruvate reductase, alter the substrate specificity, change the pH optimum, and the like.

Essential amino acids can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for pyruvate reductase activity to identify amino acid residues that are critical to the activity of the molecule. See also, Hilton et al., 1996, *J. Biol. Chem.* 271: 4699-4708. The active site of the pyruvate reductase or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identities of essential amino acids can also be inferred from analysis of identities with other pyruvate reductases that are related to the referenced pyruvate reductase.

Additional guidance on the structure-activity relationship of the pyruvate reductase herein can be determined using multiple sequence alignment (MSA) techniques well-known in the art. Based on the teachings herein, the skilled artisan could make similar alignments with any number of pyruvate reductases known in the art. Such alignments aid the skilled artisan to determine potentially relevant domains (e.g., binding domains or catalytic domains), as well as which amino acid residues are conserved and not conserved among the different pyruvate reductase sequences. It is appreciated in the art that changing an amino acid that is conserved at a particular position between the disclosed pyruvate reductase and those known in the art will more likely result in a change in biological activity (Bowie et al., 1990, *Science* 247: 1306-1310: "Residues that are directly involved in protein functions such as binding or catalysis will certainly be among the most conserved"). In contrast, substituting an amino acid that is not highly conserved among the pyruvate reductases will not likely or significantly alter the biological activity.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204), and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, Nature Biotechnology 17: 893-896). Mutagenized DNA molecules that encode active pyruvate reductases can be recovered from the host cells and rapidly sequenced using standard methods in the art. These methods allow the rapid determination of the importance of individual amino acid residues in a polypeptide.

In another embodiment, the heterologous polynucleotide encoding the pyruvate reductase comprises a coding sequence having at least 60%, e.g., at least 65%, at least 70%, at least 75%, at least 80%, at least 85%, at least 90%, at least 95%, at least 96%, at least 97%, at least 98%, at least 99%, or 100% sequence identity to SEQ ID NO: 204.

In one embodiment, the heterologous polynucleotide encoding the pyruvate reductase comprises the coding sequence of SEQ ID NO: 204. In another embodiment, the heterologous polynucleotide encoding the pyruvate reductase comprises a subsequence of the coding sequence of SEQ ID NO: 204, wherein the subsequence encodes a polypeptide having pyruvate reductase activity. In another embodiment, the number of nucleotides residues in the coding subsequence is at least 75%, e.g., at least 80%, 85%, 90%, or 95% of SEQ ID NO: 204.

The referenced coding sequence of any related aspect or embodiment described herein can be the native coding sequence or a degenerate sequence, such as a codon-optimized coding sequence designed for a particular host cell.

The polynucleotide coding sequence of SEQ ID NO: 204, or a subsequence thereof, as well as the polypeptide of SEQ ID NO: 205, or a fragment thereof, may be used to design nucleic acid probes to identify and clone DNA encoding a pyruvate reductase from strains of different genera or species according to methods well known in the art. In particular, such probes can be used for hybridization with the genomic DNA or cDNA of a cell of interest, following standard Southern blotting procedures, in order to identify and isolate the corresponding gene therein. Such probes can be considerably shorter than the entire sequence, but should be at least 15, e.g., at least 25, at least 35, or at least 70 nucleotides in length. Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}P$, $^{3}H$, $^{35}S$, biotin, or avidin).

A genomic DNA or cDNA library prepared from such other strains may be screened for DNA that hybridizes with the probes described above and encodes a parent. Genomic or other DNA from such other strains may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that hybridizes with SEQ ID NO: 204, or a subsequence thereof, the carrier material is used in a Southern blot.

In one aspect, the nucleic acid probe is a polynucleotide comprising SEQ ID NO: 204, or a subsequence thereof. In another aspect, the nucleic acid probe is a polynucleotide that encodes the polypeptide of SEQ ID NO: 205, or a fragment thereof.

For purposes of the probes described above, hybridization indicates that the polynucleotide hybridizes to a labeled nucleic acid probe, or the full-length complementary strand thereof, or a subsequence of the foregoing; under very low to very high stringency conditions. Molecules to which the nucleic acid probe hybridizes under these conditions can be detected using, for example, X-ray film. Stringency and washing conditions are defined as described supra.

In one embodiment, the pyruvate reductase is encoded by a polynucleotide that hybridizes under at least low stringency conditions, e.g., medium stringency conditions, medium-high stringency conditions, high stringency conditions, or very high stringency conditions with the full-length complementary strand of SEQ ID NO: 204. (Sambrook et al., 1989, *Molecular Cloning, A Laboratory Manual,* 2d edition, Cold Spring Harbor, N.Y.).

The pyruvate reductases may be obtained from microorganisms of any suitable genus, including those readily available within the UniProtKB database.

The pyruvate reductase may be a bacterial pyruvate reductase. For example, the pyruvate reductase may be a Gram-positive bacterial polypeptide such as a *Bacillus, Clostridium, Enterococcus, Geobacillus, Lactobacillus, Lactococcus, Oceanobacillus, Staphylococcus, Streptococcus,* or *Streptomyces* pyruvate reductase, or a Gram-negative bacterial polypeptide such as a *Campylobacter, E. coli, Flavobacterium, Fusobacterium, Helicobacter, Ilyobacter, Neisseria, Pseudomonas, Salmonella,* or *Ureaplasma* pyruvate reductase.

In one embodiment, the pyruvate reductase is a *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis,* or *Bacillus thuringiensis* pyruvate reductase.

In another embodiment, the pyruvate reductase is a *Streptococcus equisimilis, Streptococcus pyogenes, Streptococcus uberis,* or *Streptococcus equi* subsp. *Zooepidemicus* pyruvate reductase.

In another embodiment, the pyruvate reductase is a *Streptomyces achromogenes, Streptomyces avermitilis, Streptomyces coelicolor, Streptomyces griseus,* or *Streptomyces lividans* pyruvate reductase.

The pyruvate reductase may be a fungal pyruvate reductase. For example, the pyruvate reductase may be a yeast pyruvate reductase such as a *Candida, Kluyveromyces, Pichia, Saccharomyces, Schizosaccharomyces, Yarrowia* or *Issatchenkia* pyruvate reductase; or a filamentous fungal pyruvate reductase such as an *Acremonium, Agaricus, Alternaria, Aspergillus, Aureobasidium, Botryosphaeria, Ceriporiopsis, Chaetomidium, Chrysosporium, Claviceps, Cochliobolus, Coprinopsis, Coptotermes, Corynascus, Cryphonectria, Cryptococcus, Diplodia, Exidia, Filibasidium, Fusarium, Gibberella, Holomastigotoides, Humicola, Irpex, Lentinula, Leptospaeria, Magnaporthe, Melanocarpus, Meripilus, Mucor, Myceliophthora, Neocallimastix, Neurospora, Paecilomyces, Penicillium, Phanerochaete, Piromyces, Poitrasia, Pseudoplectania, Pseudotrichonympha, Rhizomucor, Schizophyllum, Scytalidium, Talaromyces, Thermoascus, Thielavia, Tolypocladium, Trichoderma, Trichophaea, Verticillium, Volvariella,* or *Xylaria* pyruvate reductase.

In another embodiment, the pyruvate reductase is a *Saccharomyces carlsbergensis, Saccharomyces cerevisiae, Saccharomyces diastaticus, Saccharomyces douglasii, Saccharomyces kluyveri, Saccharomyces norbensis,* or *Saccharomyces oviformis* pyruvate reductase.

In another embodiment, the pyruvate reductase is an *Acremonium cellulolyticus, Aspergillus aculeatus, Aspergillus awamori, Aspergillus foetidus, Aspergillus fumigatus, Aspergillus japonicus, Aspergillus nidulans, Aspergillus niger, Aspergillus oryzae, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola grisea, Humicola insolens, Humicola lanuginosa, Irpex lacteus, Mucor miehei, Myceliophthora thermophila, Neurospora crassa, Penicillium funiculosum, Penicillium purpurogenum, Phanerochaete chrysosporium, Thielavia achromatica, Thielavia albomyces, Thielavia albopilosa, Thielavia australeinsis, Thielavia fimeti, Thielavia microspora, Thielavia ovispora, Thielavia peruviana, Thielavia setosa, Thielavia spededonium, Thielavia subthermophila, Thielavia terrestris, Trichoderma harzianum, Trichoderma koningii, Trichoderma longibrachiatum, Trichoderma reesei,* or *Trichoderma viride* pyruvate reductase.

In another aspect, the pyruvate reductase is from *Issatchenkia*, such as the *Issatchenkia orientalis* pyruvate reductase of SEQ ID NO: 205.

It will be understood that for the aforementioned species, the invention encompasses both the perfect and imperfect states, and other taxonomic equivalents, e.g., anamorphs, regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen und Zellkulturen GmbH (DSMZ), Centraalbureau Voor Schimmelcultures (CBS), and Agricultural Research Service Patent Culture Collection, Northern Regional Research Center (NRRL).

Strains of these species are readily accessible to the public in a number of culture collections, such as the American Type Culture Collection (ATCC), Deutsche Sammlung von Mikroorganismen und Zellkulturen GmbH (DSM), Centraalbureau Voor Schimmelcultures (CBS), and Agricultural Research Service Patent Culture Collection, Northern Regional Research Center (NRRL).

The pyruvate reductases may also be identified and obtained from other sources including microorganisms isolated from nature (e.g., soil, composts, water, silage, etc.) or DNA samples obtained directly from natural materials (e.g., soil, composts, water, silage, etc.) using the above-mentioned probes. Techniques for isolating microorganisms and DNA directly from natural habitats are well known in the art. The polynucleotide encoding a pyruvate reductase may then be derived by similarly screening a genomic or cDNA library of another microorganism or mixed DNA sample.

Once a polynucleotide encoding a pyruvate reductase has been detected with a suitable probe as described herein, the sequence may be isolated or cloned by utilizing techniques that are known to those of ordinary skill in the art (see, e.g., Sambrook et al., 1989, supra). Techniques used to isolate or clone polynucleotides encoding pyruvate reductases include isolation from genomic DNA, preparation from cDNA, or a combination thereof. The cloning of the polynucleotides from such genomic DNA can be effected, e.g., by using the well-known polymerase chain reaction (PCR) or antibody screening of expression libraries to detect cloned DNA fragments with shares structural features. See, e.g., Innis et al., 1990, *PCR: A Guide to Methods and Application*, Academic Press, New York. Other nucleic acid amplification procedures such as ligase chain reaction (LCR), ligated activated transcription (LAT) and nucleotide sequence-based amplification (NASBA) may be used.

The pyruvate reductase may be a fused polypeptide or cleavable fusion polypeptide in which another polypeptide is fused at the N-terminus or the C-terminus of the pyruvate reductase. A fused polypeptide may be produced by fusing a polynucleotide encoding another polypeptide to a polynucleotide encoding the pyruvate reductase. Techniques for producing fusion polypeptides are known in the art, and include ligating the coding sequences encoding the polypeptides so that they are in frame and that expression of the fused polypeptide is under control of the same promoter(s) and terminator. Fusion proteins may also be constructed using intein technology in which fusions are created post-translationally (Cooper et al., 1993, *EMBO J.* 12: 2575-2583; Dawson et al., 1994, *Science* 266: 776-779).

In some embodiments, the recombinant cells described supra comprising a heterologous polynucleotide encoding a pyruvate reductase produce have an increased level of pyruvate reductase activity compared to the host cells without the heterologous polynucleotide encoding the pyruvate reductase, when cultivated under the same conditions (e.g., at least 5%, at least 10%, at least 15%, at least 20%, at least 25%, at least 50%, at least 100%, at least 150%, at least 200%, at least 300%, or at 500% more).

In some embodiments, the host cells described supra comprising a heterologous polynucleotide encoding a pyruvate reductase are capable of producing D-lactate. Accordingly, in one aspect is a method of producing D-lactate or a salt thereof, comprising: (a) cultivating a recombinant cell comprising a heterologous polynucleotide encoding a pyruvate reductase described herein (e.g., the pyruvate reductase of SEQ ID NO: 205), in a fermentable medium under suitable conditions to produce D-lactate or salt thereof; and (b) recovering the D-lactate. Suitable fermentation conditions are known in the art and describe greater detail herein.

In some embodiments, the host cells described supra comprising a heterologous polynucleotide encoding a pyruvate reductase produce (and/or are capable of producing) a greater amount of D-lactate compared to cells without the heterologous polynucleotide encoding the pyruvate reductase when cultivated under the same conditions (e.g., at least 15%, at least 20%, at least 25%, at least 30%, at least 35%, at least 40%, at least 45%, at least 50%, at least 75%, at least 100%, at least 200%, at least 300%, or at 500% more).

Pyruvate Reductase Gene Disruption

In one aspect, is a mutant strain comprising a disruption to an endogenous gene that encodes for a pyruvate reductase. The strain may be any suitable microbial cell, such as any of the host cells described below.

In some embodiments of the mutants and related methods, the endogenous gene encodes a pyruvate reductase that comprises or consists of the amino acid sequence of SEQ ID NO: 205. In some aspects, the endogenous gene encodes a pyruvate reductase having at least 20%, e.g., at least 40%, at least 50%, at least 60%, at least 70%, at least 80%, at least 90%, at least 95%, at least 96%, at least 97%, at least 98%, at least 99%, or 100% of the pyruvate reductase activity of SEQ ID NO: 205, under the same conditions.

In some embodiments of the mutants and related methods, the endogenous gene encodes a pyruvate reductase having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to SEQ ID NO: 205. In one embodiment, the pyruvate reductase sequence differs by no more than ten amino acids, e.g., by no more than five amino acids, by no more than four amino acids, by no more than three amino acids, by no more than two amino acids, or by one amino acid from SEQ ID NO: 205. In one embodiment, the pyruvate reductase comprises or consists of the amino acid sequence of SEQ ID NO: 205, or an allelic variant, or a fragment thereof having pyruvate reductase activity. In one embodiment, the pyruvate reductase has an amino acid substitution, deletion, and/or insertion of one or more (e.g., two, several) amino acids of SEQ ID NO: 205. In some embodiments, the total number of amino acid substitutions, deletions and/or insertions is not more than 10, e.g., not more than 9, 8, 7, 6, 5, 4, 3, 2, or 1.

In some embodiments of the mutants and related methods, the coding sequence of the endogenous gene encoding the pyruvate reductase has at least 60%, e.g., at least 65%, at least 70%, at least 75%, at least 80%, at least 85%, at least 90%, at least 95%, at least 96%, at least 97%, at least 98%, at least 99%, or 100% sequence identity to SEQ ID NO: 204.

In some embodiments, the coding sequence of the endogenous gene comprises or consists of SEQ ID NO: 204.

In some embodiments of the mutants and related methods, the coding sequence of the endogenous gene encoding the pyruvate reductase hybridizes under at least low stringency conditions, e.g., medium stringency conditions, medium-high stringency conditions, high stringency conditions, or very high stringency conditions with the full-length complementary strand of SEQ ID NO: 204. (Sambrook et al., 1989, *Molecular Cloning, A Laboratory Manual*, 2d edition, Cold Spring Harbor, N.Y.).

In some embodiments of the mutants and related methods, the mutant produces less D-lactate (e.g., at least 25% less, 50% less, at least 60% less, at least 70% less, at least 80% less, at least 90% less, or 100% less) compared to the parent strain that lacks disruption of the endogenous gene encoding for the pyruvate reductase, when cultivated under identical conditions.

In some embodiments of the mutants and related methods, the mutant produces less pyruvate reductase (e.g., at least 25% less, at least 50% less, at least 60% less, at least 70% less, at least 80% less, at least 90% less, or 100% less) compared to the parent strain that lacks disruption of the endogenous gene encoding for the pyruvate reductase, when cultivated under identical conditions. In some embodiments, the endogenous gene encoding the pyruvate reductase is inactivated.

The mutant strains described herein may be constructed by disrupting the referenced endogenous pyruvate reductase using methods well known in the art, including those methods described herein. A portion of the operon can be disrupted such as one or more (e.g., two, several) coding regions or a control sequence required for expression of the coding regions. Such a control sequence of the operon may be a promoter sequence or a functional part thereof, i.e., a part that is sufficient for affecting expression of the operon. For example, a promoter sequence may be inactivated resulting in no expression or a weaker promoter may be substituted for the native promoter sequence to reduce expression of the coding sequences. Other control sequences for possible modification include, but are not limited to, a leader, propeptide sequence, signal sequence, transcription terminator, and transcriptional activator.

The mutant strains may be constructed by gene deletion techniques to eliminate or reduce expression of the pyruvate reductase coding sequence. Gene deletion techniques enable the partial or complete removal of the operon thereby eliminating expression. In such methods, deletion of the operon is accomplished by homologous recombination using one or more plasmids that have been constructed to contiguously contain the 5' and 3' regions flanking the genes.

The mutant strains may also be constructed by introducing, substituting, and/or removing one or more (e.g., two, several) nucleotides in the pyruvate reductase coding sequence or a control sequence thereof required for the transcription or translation thereof. For example, nucleotides may be inserted or removed for the introduction of a stop codon, the removal of the start codon, or a frame-shift of the open reading frame. Such a modification may be accomplished by site-directed mutagenesis or PCR generated mutagenesis in accordance with methods known in the art. See, for example, Botstein and Shortle, 1985, *Science* 229: 4719; Lo et al., 1985, *Proc. Natl. Acad. Sci. USA* 81: 2285; Higuchi et al., 1988, *Nucleic Acids Res* 16: 7351; Shimada, 1996, *Meth. Mol. Biol.* 57: 157; Ho et al., 1989, *Gene* 77: 51; Horton et al., 1989, *Gene* 77: 61; and Sarkar and Sommer, 1990, *BioTechniques* 8: 404.

The mutant strains may also be constructed by gene disruption techniques by inserting into the pyruvate reductase gene a disruptive nucleic acid construct comprising a nucleic acid fragment homologous to the coding sequence that will create a duplication of the region of homology and incorporate construct DNA between the duplicated regions. Such a gene disruption can eliminate expression if the inserted construct separates the promoter of the gene from the coding region or interrupts the coding sequence such that a non-functional or functionally reduced coding sequence results. A disrupting construct may be simply a selectable marker gene accompanied by 5' and 3' regions homologous to the gene. The selectable marker enables identification of transformants containing the disrupted gene.

The mutant strains may also be constructed by the process of gene conversion (see, for example, Iglesias and Trautner, 1985, *Molecular General Genetics* 189: 73-76). For example, in the gene conversion method, a nucleotide sequence corresponding to a sequence in the gene is mutagenized in vitro to produce a defective nucleotide sequence, which is then transformed into the parent strain to produce a defective gene. By homologous recombination, the defective nucleotide sequence replaces the endogenous sequence. It may be desirable that the defective nucleotide sequence also comprises a marker for selection of transformants containing the defective sequence.

The mutant strains may be further constructed by random or specific mutagenesis using methods well known in the art, including, but not limited to, chemical mutagenesis (see, for example, Hopwood, *The Isolation of Mutants in Methods in Microbiology* (J. R. Norris and D. W. Ribbons, eds.) pp. 363-433, Academic Press, New York, 1970). Modification of the gene may be performed by subjecting the parent strain to mutagenesis and screening for mutant strains in which expression of the gene has been reduced or inactivated. The mutagenesis, which may be specific or random, may be performed, for example, by use of a suitable physical or chemical mutagenizing agent, use of a suitable oligonucleotide, or subjecting the DNA sequence to PCR generated mutagenesis. Furthermore, the mutagenesis may be performed by use of any combination of these mutagenizing methods.

Examples of a physical or chemical mutagenizing agent suitable for the present purpose include ultraviolet (UV) irradiation, hydroxylamine, N-methyl-N'-nitro-N-nitrosoguanidine (MNNG), N-methyl-N'-nitrosoguanidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the parent strain to be mutagenized in the presence of the mutagenizing agent of choice under suitable conditions, and selecting for mutants exhibiting reduced or no expression of the gene.

A nucleotide sequence homologous or complementary to a sequence described herein may be used from other microbial sources to disrupt the corresponding sequence in a strain of choice.

In one aspect, disruption of the gene in the mutant is unmarked with a selectable marker. Removal of the selectable marker gene may be accomplished by culturing the mutants on a counter-selection medium. Where the selectable marker gene contains repeats flanking its 5' and 3' ends, the repeats will facilitate the looping out of the selectable marker gene by homologous recombination when the mutant strain is submitted to counter-selection. The selectable marker gene may also be removed by homologous recombination by introducing into the mutant strain a nucleic acid fragment comprising 5' and 3' regions of the defective gene, but lacking the selectable marker gene, followed by selecting on the counter-selection medium. By homologous recombination, the defective gene containing the selectable marker gene is replaced with the nucleic acid fragment lacking the selectable marker gene. Other methods known in the art may also be used.

Also described are methods of producing the mutants described herein. In one aspect is a method for obtaining a mutant described herein, comprising disrupting in a parent strain an endogenous gene encoding a pyruvate reductase. In another aspect is a method for obtaining a mutant described herein, comprising: (a) cultivating a parent strain; (b) disrupting an endogenous gene encoding a pyruvate reductase in the parent strain of (a); and (c) isolating the mutant strain resulting from (b).

Hosts, Expression Vectors and Nucleic Acid Constructs

The recombinant host cells and/or mutant strains described herein may be selected from any suitable microbial cell (such as a host cell capable of having an active 3-HP pathway described below). Those skilled in the art will understand that the genetic alterations, including metabolic modifications exemplified herein, may be described with reference to a suitable host organism and their corresponding metabolic reactions or a suitable source organism for desired genetic material such as genes for a desired metabolic pathway. However, given the complete genome sequencing of a wide variety of organisms and the high level of skill in the area of genomics, those skilled in the art can apply the teachings and guidance provided herein to other organisms. For example, the metabolic alterations exemplified herein can readily be applied to other species by incorporating the same or analogous encoding nucleic acid from species other than the referenced species. In some embodiments, the host cells and/or mutant strains are isolated.

The host cell may be any Gram-positive or Gram-negative bacterium. Gram-positive bacteria include, but are not limited to, *Bacillus, Clostridium, Enterococcus, Geobacillus, Lactobacillus, Lactococcus, Oceanobacillus, Staphylococcus, Streptococcus*, and *Streptomyces*. Gram-negative bacteria include, but are not limited to, *Campylobacter, E. coli, Flavobacterium, Fusobacterium, Helicobacter, Ilyobacter, Neisseria, Pseudomonas, Salmonella*, and *Ureaplasma*.

The bacterial host cell may be any *Bacillus* cell including, but not limited to, *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis*, and *Bacillus thuringiensis* cells.

The bacterial host cell may also be any *Streptococcus* cell including, but not limited to, *Streptococcus equisimilis, Streptococcus pyogenes, Streptococcus uberis*, and *Streptococcus equi* subsp. *Zooepidemicus* cells.

The bacterial host cell may also be any *Streptomyces* cell, including, but not limited to, *Streptomyces achromogenes, Streptomyces avermitilis, Streptomyces coelicolor, Streptomyces griseus*, and *Streptomyces lividans* cells.

The introduction of DNA into a *Bacillus* cell may be effected by protoplast transformation (see, e.g., Chang and Cohen, 1979, Mol. Gen. Genet. 168: 111-115), competent cell transformation (see, e.g., Young and Spizizen, 1961, *J. Bacteriol.* 81: 823-829, or Dubnau and Davidoff-Abelson, 1971, *J. Mol. Biol.* 56: 209-221), electroporation (see, e.g., Shigekawa and Dower, 1988, *Biotechniques* 6: 742-751), or conjugation (see, e.g., Koehler and Thorne, 1987, *J. Bacte-* riol. 169: 5271-5278). The introduction of DNA into an *E. coli* cell may be effected by protoplast transformation (see, e.g., Hanahan, 1983, *J. Mol. Biol.* 166: 557-580) or electroporation (see, e.g., Dower et al., 1988, *Nucleic Acids Res.* 16: 6127-6145). The introduction of DNA into a *Streptomyces* cell may be effected by protoplast transformation, electroporation (see, e.g., Gong et al., 2004, *Folia Microbiol. (Praha)* 49: 399-405), conjugation (see, e.g., Mazodier et al., 1989, *J. Bacteriol.* 171: 3583-3585), or transduction (see, e.g., Burke et al., 2001, *Proc. Natl. Acad. Sci. USA* 98: 6289-6294). The introduction of DNA into a *Pseudomonas* cell may be effected by electroporation (see, e.g., Choi et al., 2006, *J. Microbiol. Methods* 64: 391-397), or conjugation (see, e.g., Pinedo and Smets, 2005, *Appl. Environ. Microbiol.* 71: 51-57). The introduction of DNA into a *Streptococcus* cell may be effected by natural competence (see, e.g., Perry and Kuramitsu, 1981, *Infect. Immun.* 32: 1295-1297), protoplast transformation (see, e.g., Catt and Jollick, 1991, *Microbios* 68: 189-207), electroporation (see, e.g., Buckley et al., 1999, *Appl. Environ. Microbiol.* 65: 3800-3804) or conjugation (see, e.g., Clewell, 1981, *Microbiol. Rev.* 45: 409-436). However, any method known in the art for introducing DNA into a host cell can be used.

The host cell may also be a eukaryote, such as a mammalian, insect, plant, or fungal cell.

"Fungi" as used herein includes the phyla Ascomycota, Basidiomycota, Chytridiomycota, and Zygomycota as well as the Oomycota and all mitosporic fungi (as defined by Hawksworth et al., In, *Ainsworth and Bisby's Dictionary of The Fungi*, 8th edition, 1995, CAB International, University Press, Cambridge, UK).

In one embodiment, the host cell is a yeast cell. "Yeast" as used herein includes ascosporogenous yeast (Endomycetales), basidiosporogenous yeast, and yeast belonging to the Fungi Imperfecti (Blastomycetes). Since the classification of yeast may change in the future, for the purposes described herein, yeast shall be defined as described in *Biology and Activities of Yeast* (Skinner, F. A., Passmore, S. M., and Davenport, R. R., eds, *Soc. App. Bacteriol. Symposium Series* No. 9, 1980).

The yeast host cell may be a *Candida, Hansenula, Issatchenkia, Kluyveromyces, Pichia, Saccharomyces, Schizosaccharomyces,* or *Yarrowia* cell, such as a *Candida sonorensis, Candida methanosorbosa, Candida ethanolica, Issatchenkia orientalis, Kluyveromyces lactis, Kluyveromyces marxianus, Pichia fermentans, Pichia galeiformis, Pichia membranifaciens, Pichia deserticola, Saccharomyces carlsbergensis, Saccharomyces cerevisiae, Saccharomyces diastaticus, Saccharomyces bulderi, Saccharomyces douglasii, Saccharomyces kluyveri, Saccharomyces norbensis, Saccharomyces oviformis,* or *Yarrowia lipolytica* cell.

The yeast host cell may be a crabtree-positive phenotype or a crabtree-negative phenotype. Crabtree-negative organisms are characterized by the ability to be induced into an increased fermentative state. Both naturally occurring organisms and recombinant organisms can be characterized as Crabtree-negative. The Crabtree effect is defined as oxygen consumption inhibition in a microorganism when the microorganism is cultured under aerobic conditions in the presence of a high concentration of glucose (e.g. >5 mM glucose). Crabtree-positive organisms continue to ferment (rather than respire) irrespective of oxygen availability in the presence of glucose, while Crabtree-negative organisms do not exhibit glucose-mediated inhibition of oxygen consumption. This characteristic is useful for organic product synthesis, since it permits cells to be grown at high substrate concentrations but to retain the beneficial energetic effects of oxidative phosphorylation. In one aspect, the yeast has a crabtree-negative phenotype.

In certain embodiments the host yeast cell belongs to the genus *Issatchenkia, Candida,* or *Saccharomyces,* and in certain of these embodiments the host cell belongs to the *I. orientalis/P. fermentans* or *Saccharomyces* clade. In certain of embodiments, the host cell is *I. orientalis* or *C. lambica,* or *S. bulderi.* In certain embodiments, the yeast cells are CNB1 yeast cells (as described in WO2012/074818, the content of which is incorporated herein by reference) and/or CB1 yeast cells. CB1 cells include CNB1 cells described in WO2012/074818 and any cell related to or derived from the CNB1 cells described therein.

The yeast host cell may be derived from a cell or engineered such that the cell has been genetically modified to produce high lactate or 3-HP titers, exhibit increased tolerance to acidic pH, exhibit increased tolerance to a fermentation product (e.g., lactate, 3-HP, ethanol or propanol), and/or display increased ability to ferment pentose sugars (yet, in some embodiments, the yeast cell is unable to ferment pentose sugars). Exemplary genetically modified yeast cells are described in WO00/71738, WO03/049525, WO03/102201, WO03/102152, WO02/42471, WO2007/032792, WO2007/106524, WO2007/117282, the content of which is hereby incorporated by reference with respect to said cells. The modification of any yeast cell described in the foregoing applications is contemplated with an active 3-HP pathway as described below.

As mentioned supra, the host cell may have improved resistance to lactate and/or 3-HP. In certain embodiments, the host cells are "3-HP resistant yeast cells," as described in US2012/0135481. In certain of these embodiments, the host cells may exhibit 3-HP resistance in their native form. In other embodiments, the cells may have undergone mutation and/or selection (e.g., chemostat selection or repeated serial subculturing) before, during, or after introduction of genetic modifications related to an active 3-HP pathway, such that the mutated and/or selected cells possess a higher degree of resistant to 3-HP than wild-type cells of the same species. For example, in some embodiments, the cells have undergone mutation and/or selection in the presence of 3-HP or lactic acid before or after being genetically modified with one or more heterologous 3-HP pathway genes. In certain embodiments, mutation and/or selection may be carried out on cells that exhibit 3-HP resistance in their native form. Cells that have undergone mutation and/or selection may be tested for sugar consumption and other characteristics in the presence of varying levels of 3-HP in order to determine their potential as industrial hosts for 3-HP production. In addition to 3-HP resistance, the host cells may have undergone mutation and/or selection for resistance to one or more additional organic acids (e.g., lactic acid) or to other fermentation products, byproducts, or media components. Selection, such as selection for resistance to 3-HP or to other compounds, may be accomplished using methods well known in the art (e.g., as described in US2012/0135481).

In one embodiment, the host cell is a filamentous fungal cell. "Filamentous fungi" include all filamentous forms of the subdivision Eumycota and Oomycota (as defined by Hawksworth et al., 1995, supra). The filamentous fungi are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces* cerevisiae is by budding of a unicellular thallus and carbon catabolism may be fermentative.

The filamentous fungal host cell may be an *Acremonium, Aspergillus, Aureobasidium, Bjerkandera, Ceriporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes,* or *Trichoderma* cell.

For example, the filamentous fungal host cell may be an *Aspergillus awamori, Aspergillus foetidus, Aspergillus fumigatus, Aspergillus japonicus, Aspergillus nidulans, Aspergillus niger, Aspergillus oryzae, Bjerkandera adusta, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor, Trichoderma harzianum, Trichoderma koningii, Trichoderma longibrachiatum, Trichoderma reesei,* or *Trichoderma viride* cell.

Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238023, Yelton et al., 1984, *Proc. Natl. Acad. Sci. USA* 81: 1470-1474, and Christensen et al., 1988, *Bio/Technology* 6: 1419-1422. Suitable methods for transforming *Fusarium* species are described by Malardier et al., 1989, *Gene* 78: 147-156, and WO 96/00787. Yeast may be transformed using the procedures described by Becker and Guarente, In Abelson, J. N. and Simon, M. I., editors, *Guide to Yeast Genetics and Molecular Biology, Methods in Enzymology*, Volume 194, pp 182-187, Academic Press, Inc., New York; Ito et al., 1983, *J. Bacteriol.* 153: 163; and Hinnen et al., 1978, *Proc. Natl. Acad. Sci. USA* 75: 1920, or as described herein.

The ideal cell for organic acids, such as lactic acid or 3-HP, is capable of growing at low pH levels. The ability to conduct fermentation at a low pH decreases downstream recovery costs, resulting in more economical production. Therefore, in certain embodiments the host cell is capable of growing at low pH levels (e.g., at pH levels less than 7, 6, 5, 4, or 3).

A suitable host cell may possess one or more favorable characteristics in addition to organic acid resistance and/or low pH growth capability. For example, potential host cells exhibiting acid resistance may be further selected based on glycolytic rates, specific growth rates, thermotolerance, tolerance to biomass hydrolysate inhibitors, overall process robustness, and so on. These criteria may be evaluated prior to any genetic modification relating to a metabolic pathway, or they may be evaluated after one or more such modifications have taken place.

In any of these aspects, the recombinant cell produces (and/or is capable of producing) a fermentation product, such as D-lactate or 3-HP, at a yield of at least 10%, e.g., at least 20%, at least 30%, at least 40%, at least 50%, at least 60%, at least 70%, at least 80%, or at least 90%, of theoretical.

In any of these aspects, the recombinant cell has a volumetric productivity (e.g., D-lactate or 3-HP volumetric productivity) greater than about 0.1 g/L per hour, e.g., greater than about 0.2 g/L per hour, 0.5 g/L per hour, 0.6 g/L per hour, 0.7 g/L per hour, 0.8 g/L per hour, 0.9 g/L per hour, 1.0 g/L per hour, 1.1 g/L per hour, 1.2 g/L per hour, 1.3 g/L per hour, 1.5 g/L per hour, 1.75 g/L per hour, 2.0 g/L per hour, 2.25 g/L per hour, 2.5 g/L per hour, 2.75 g/L per hour, 3.0 g/L per hour, 3.25 g/L per hour, 3.5 g/L per hour, 3.75 g/L per hour, or 4.0 g/L per hour; or between about 0.1 g/L per hour and about 2.0 g/L per hour, e.g., between about 0.3 g/L per hour and about 1.7 g/L per hour, about 0.5 g/L per hour and about 1.5 g/L per hour, about 0.7 g/L per hour and about 1.3 g/L per hour, about 0.8 g/L per hour and about 1.2 g/L per hour, or about 0.9 g/L per hour and about 1.1 g/L per hour; or between about 0.1 g/L per hour and about 4.0 g/L per hour, e.g., between about 0.5 g/L per hour and about 3.75 g/L per hour, about 1.0 g/L per hour and about 3.5 g/L per hour, about 2.0 g/L per hour and about 3.25 g/L per hour.

The recombinant cells may be cultivated in a suitable nutrient medium using methods well known in the art. For example, the cell may be cultivated by shake flask cultivation, and small-scale or large-scale fermentation (including continuous, batch, fed-batch, or solid state fermentations) in laboratory or industrial fermentors performed in a suitable medium and under conditions allowing the desired polypeptide to be expressed and/or isolated. The cultivation takes place in a suitable nutrient medium comprising carbon and nitrogen sources and inorganic salts, as described herein, using procedures known in the art. Suitable media are available from commercial suppliers, may be prepared according to published compositions (e.g., in catalogues of the American Type Culture Collection), or may be prepared from commercially available ingredients.

The recombinant cells described herein also can be subjected to adaptive evolution to further augment product biosynthesis, including under conditions approaching theoretical maximum growth.

The recombinant cells described herein may utilize expression vectors comprising the coding sequence of one or more (e.g., two, several) heterologous 3-HP pathway genes linked to one or more control sequences that direct expression in a suitable cell under conditions compatible with the control sequence(s). Such expression vectors may be used in any of the cells and methods described herein. The polynucleotides described herein may be manipulated in a variety of ways to provide for expression of a desired polypeptide. Manipulation of the polynucleotide prior to its insertion into a vector may be desirable or necessary depending on the expression vector. The techniques for modifying polynucleotides utilizing recombinant DNA methods are well known in the art.

A construct or vector (or multiple constructs or vectors) comprising the one or more (e.g., two, several) heterologous 3-HP pathway genes may be introduced into a cell so that the construct or vector is maintained as a chromosomal integrant or as a self-replicating extra-chromosomal vector as described earlier.

The various nucleotide and control sequences may be joined together to produce a recombinant expression vector that may include one or more (e.g., two, several) convenient restriction sites to allow for insertion or substitution of the polynucleotide at such sites. Alternatively, the polynucleotide(s) may be expressed by inserting the polynucleotide(s) or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

In one aspect, the recombinant cell comprises a heterologous polynucleotide is contained in an independent vector. In one aspect, the recombinant cell comprises a plurality of heterologous polynucleotides each contained in an independent vector. In one aspect, the recombinant cell comprises at least two heterologous polynucleotides contained in a single vector. In one aspect, the recombinant cell comprises at least three of the heterologous polynucleotides contained on a single vector. In one aspect, the recombinant cell comprises at least four of the heterologous polynucleotides contained on a single vector. In one aspect, all the heterologous polynucleotides of the recombinant cell are contained on a single vector. Polynucleotides encoding heteromeric subunits of a protein complex may be contained in a single heterologous polynucleotide on a single vector or alternatively contained in separate heterologous polynucleotides on separate vectors.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the cell, or a transposon, may be used.

The expression vector may contain any suitable promoter sequence that is recognized by a cell for expression of a pyruvate reductase gene or any 3-HP pathway gene described herein. The promoter sequence contains transcriptional control sequences that mediate the expression of the polypeptide. The promoter may be any polynucleotide that shows transcriptional activity in the cell of choice including mutant, truncated, and hybrid promoters, and may be obtained from genes encoding extracellular or intracellular polypeptides either homologous or heterologous to the cell.

Each heterologous polynucleotide described herein may be operably linked to a promoter that is foreign to the polynucleotide. For example, in one aspect, the heterologous polynucleotide encoding the pyruvate reductase is operably linked to a promoter foreign to the polynucleotide. In another aspect, the heterologous polynucleotide encoding a polypeptide of a 3-HP pathway described herein (e.g., a PPC, PYC, AAT, ADC, BAAT, gabT, or 3-HPDH) is operably linked to promoter foreign to the polynucleotide. The promoters may be identical to or share a high degree of sequence identity (e.g., at least about 80%, at least about 85%, at least about 90%, at least about 95%, or at least about 99%) with a selected native promoter.

Examples of suitable promoters for directing transcription of the nucleic acid constructs of the present invention in a bacterial host cell are the promoters obtained from the *Bacillus amyloliquefaciens* alpha-amylase gene (amyQ), *Bacillus licheniformis* alpha-amylase gene (amyL), *Bacillus licheniformis* penicillinase gene (penP), *Bacillus stearothermophilus* maltogenic amylase gene (amyM), *Bacillus subtilis* levansucrase gene (sacB), *Bacillus subtilis* xylA and xylB genes, *Bacillus thuringiensis* cryIIIA gene (Agaisse and Lereclus, 1994, *Molecular Microbiology* 13: 97-107), *E. coli* lac operon, *E. coli* trc promoter (Egon et al., 1988, *Gene* 69: 301-315), *Streptomyces coelicolor* agarase gene (dagA), and prokaryotic beta-lactamase gene (Villa-Kamaroff et al., 1978, *Proc. Natl. Acad. Sci. USA* 75: 3727-3731), as well as the tac promoter (DeBoer et al., 1983, *Proc. Natl. Acad. Sci. USA* 80: 21-25). Further promoters are described in "Useful proteins from recombinant bacteria" in Gilbert et al., 1980, *Scientific American* 242: 74-94; and in Sambrook et al., 1989, supra. Examples of tandem promoters are disclosed in WO 99/43835.

Examples of suitable promoters for directing the transcription of the nucleic acid constructs in a yeast cells, include, but are not limited to, the promoters obtained from the genes for enolase, (e.g., *S. cerevisiae* enolase or *I. orientalis* enolase (ENO1)), galactokinase (e.g., *S. cerevisiae* galactokinase or *I. orientalis* galactokinase (GAL1)), alcohol dehydrogenase/glyceraldehyde-3-phosphate dehydrogenase (e.g., *S. cerevisiae* alcohol dehydrogenase/glyceraldehyde-3-phosphate dehydrogenase or *I. orientalis* alcohol dehydrogenase/glyceraldehyde-3-phosphate dehydrogenase (ADH1, ADH2/GAP)), triose phosphate isomerase (e.g., *S. cerevisiae* triose phosphate isomerase or *I. orientalis* triose phosphate isomerase (TPI)), metallothionein (e.g., *S. cerevisiae* metallothionein or *I. orientalis* metallothionein (CUP1)), 3-phosphoglycerate kinase (e.g., *S. cerevisiae* 3-phosphoglycerate kinase or *I. orientalis* 3-phosphoglycerate kinase (PGK)), PDC1, xylose reductase (XR), xylitol dehydrogenase (XDH), L-(+)-lactate-cytochrome c oxidoreductase (CYB2), translation elongation factor-1 (TEF1), translation elongation factor-2 (TEF2), glyceraldehyde-3-phosphate dehydrogenase (GAPDH), and orotidine 5'-phosphate decarboxylase (URA3) genes. Other useful promoters for yeast host cells are described by Romanos et al., 1992, *Yeast* 8: 423-488.

Examples of suitable promoters for directing transcription of the nucleic acid constructs of the present invention in a filamentous fungal host cell are promoters obtained from the genes for *Aspergillus nidulans* acetamidase, *Aspergillus niger* neutral alpha-amylase, *Aspergillus niger* acid stable alpha-amylase, *Aspergillus niger* or *Aspergillus awamori* glucoamylase (glaA), *Aspergillus oryzae* TAKA amylase, *Aspergillus oryzae* alkaline protease, *Aspergillus oryzae* triose phosphate isomerase, *Fusarium oxysporum* trypsin-like protease (WO 96/00787), *Fusarium venenatum* amyloglucosidase (WO 00/56900), *Fusarium venenatum* Daria (WO 00/56900), *Fusarium venenatum* Quinn (WO 00/56900), *Rhizomucor miehei* lipase, *Rhizomucor miehei* aspartic proteinase, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase IV, *Trichoderma reesei* endoglucanase V, *Trichoderma reesei* xylanase I, *Trichoderma reesei* xylanase II, *Trichoderma reesei* beta-xylosidase, as well as the NA2-tpi promoter (a modified promoter from an *Aspergillus* neutral alpha-amylase gene in which the untranslated leader has been replaced by an untranslated leader from an *Aspergillus* triose phosphate isomerase gene; non-limiting examples include modified promoters from an *Aspergillus niger* neutral alpha-amylase gene in which the untranslated leader has been replaced by an untranslated leader from an *Aspergillus nidulans* or *Aspergillus oryzae* triose phosphate isomerase gene); and mutant, truncated, and hybrid promoters thereof.

The control sequence may also be a suitable transcription terminator sequence, which is recognized by a host cell to terminate transcription. The terminator sequence is operably linked to the 3'-terminus of the polynucleotide encoding the polypeptide. Any terminator that is functional in the yeast cell of choice may be used. The terminator may be identical to or share a high degree of sequence identity (e.g., at least about 80%, at least about 85%, at least about 90%, at least about 95%, or at least about 99%) with the selected native terminator. In certain embodiments, 3-HP pathway genes are linked to a terminator that comprises a functional portion of a native GAL10 gene native to the host cell or a sequence that shares at least 80%, at least 85%, at least 90%, or at least 95% sequence identity with a native GAL10 terminator.

Suitable terminators for bacterial host cells may be obtained from the genes for *Bacillus clausii* alkaline protease (aprH), *Bacillus licheniformis* alpha-amylase (amyL), and *Escherichia coli* ribosomal RNA (rrnB).

Suitable terminators for yeast host cells may be obtained from the genes for enolase (e.g., *S. cerevisiae* or *I. orientalis* enolase cytochrome C (e.g., *S. cerevisiae* or *I. orientalis* cytochrome (CYC1)), glyceraldehyde-3-phosphate dehydrogenase (e.g., *S. cerevisiae* or *I. orientalis* glyceraldehyde-3-phosphate dehydrogenase (gpd)), PDC1, XR, XDH, transaldolase (TAL), transketolase (TKL), ribose 5-phosphate ketol-isomerase (RKI), CYB2, and the galactose family of genes (especially the GAL10 terminator). Other useful terminators for yeast host cells are described by Romanos et al., 1992, supra.

Suitable terminators for filamentous fungal host cells may be obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

The control sequence may also be an mRNA stabilizer region downstream of a promoter and upstream of the coding sequence of a gene which increases expression of the gene.

Examples of suitable mRNA stabilizer regions are obtained from a *Bacillus thuringiensis* cryIIIA gene (WO 94/25612) and a *Bacillus subtilis* SP82 gene (Hue et al., 1995, *Journal of Bacteriology* 177: 3465-3471).

The control sequence may also be a suitable leader sequence, when transcribed is a nontranslated region of an mRNA that is important for translation by the host cell. The leader sequence is operably linked to the 5'-terminus of the polynucleotide encoding the polypeptide. Any leader sequence that is functional in the yeast cell of choice may be used.

Suitable leaders for yeast host cells are obtained from the genes for enolase (e.g., *S. cerevisiae* or *I. orientalis* enolase (ENO-1)), 3-phosphoglycerate kinase (e.g., *S. cerevisiae* or *I. orientalis* 3-phosphoglycerate kinase), alpha-factor (e.g., *S. cerevisiae* or *I. orientalis* alpha-factor), and alcohol dehydrogenase/glyceraldehyde-3-phosphate dehydrogenase (e.g., *S. cerevisiae* or *I. orientalis* alcohol dehydrogenase/glyceraldehyde-3-phosphate dehydrogenase (ADH2/GAP)).

Preferred leaders for filamentous fungal host cells are obtained from the genes for *Aspergillus oryzae* TAKA amylase and *Aspergillus nidulans* triose phosphate isomerase.

The control sequence may also be a polyadenylation sequence; a sequence operably linked to the 3'-terminus of the polynucleotide and, when transcribed, is recognized by the host cell as a signal to add polyadenosine residues to transcribed mRNA. Any polyadenylation sequence that is functional in the host cell of choice may be used. Useful polyadenylation sequences for yeast cells are described by Guo and Sherman, 1995, Mol. Cellular Biol. 15: 5983-5990. Preferred polyadenylation sequences for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

It may also be desirable to add regulatory sequences that allow the regulation of the expression of the polypeptide relative to the growth of the host cell. Examples of regulatory systems are those that cause the expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In filamentous fungi, the *Aspergillus niger* glucoamylase promoter, *Aspergillus oryzae* TAKA alpha-amylase promoter, and *Aspergillus oryzae* glucoamylase promoter may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the polypeptide would be operably linked with the regulatory sequence.

The vectors may contain one or more (e.g., two, several) selectable markers that permit easy selection of transformed, transfected, transduced, or the like cells. A selectable marker is a gene the product of which provides for biocide or viral resistance, resistance to heavy metals, prototrophy to auxotrophs, and the like.

Examples of bacterial selectable markers are *Bacillus licheniformis* or *Bacillus subtilis* dal genes, or markers that confer antibiotic resistance such as ampicillin, chloramphenicol, kanamycin, neomycin, spectinomycin or tetracycline resistance. Suitable markers for yeast host cells include, but are not limited to, ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene.

The vectors may contain one or more (e.g., two, several) elements that permit integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination. Potential integration loci include those described in the art (e.g., See US2012/0135481).

For autonomous replication, the vector may further comprise an origin of replication enabling the vector to replicate autonomously in the yeast cell. The origin of replication may be any plasmid replicator mediating autonomous replication that functions in a cell. The term "origin of replication" or "plasmid replicator" means a polynucleotide that enables a plasmid or vector to replicate in vivo.

Examples of bacterial origins of replication are the origins of replication of plasmids pBR322, pUC19, pACYC177, and pACYC184 permitting replication in *E. coli*, and pUB110, pE194, pTA1060, and pAMβ1 permitting replication in *Bacillus*.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANSI (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide described herein may be inserted into a host cell to increase production of a polypeptide. An increase in the copy number of the polynucleotide can be obtained by integrating at least one additional copy of the sequence into the yeast cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors described herein are well known to one skilled in the art (see, e.g., Sambrook et al., 1989, supra).

Additional procedures and techniques known in the art for the preparation of recombinant cells comprising one or more 3-HP pathway genes, are described in, e.g., WO 2012/074818, the content of which is hereby incorporated by reference.

Active 3-HP Pathway

The host cells described herein, such as the mutant cells comprising a disruption to a pyruvate reductase gene described supra, may further comprise an active 3-HP pathway. 3-HP pathways, 3-HP pathway genes and corresponding engineered transformants for fermentation of 3-HP are known in the art (e.g., US Publication No. 2012/0135481; U.S. Pat. Nos. 6,852,517; 7,309,597; US Pub. No. 2001/0021978; US Pub. No. 2008/0199926; WO02/42418; and WO10/031083; the content of which is hereby incorporated in its entirety). An overview of several known 3-HP pathways is shown in FIG. 1.

In certain embodiments, the recombinant cells provided herein have an active 3-HP pathway that proceeds through a malonate semialdehyde intermediate. Several 3-HP pathways are known in the art to proceed through a malonate semialdehyde intermediate. For example, the cells may have an active 3-HP pathway that proceeds through PEP or pyruvate, OAA, aspartate, β-alanine, and malonate semialdehyde intermediates (see, e.g., U.S. Pat. No. 7,186,541; FIG. 55). In these embodiments, the recombinant cells comprise a set of 3-HP pathway genes comprising one or more of pyruvate carboxylase (PYC), PEP carboxylase (PPC), aspartate aminotransferase (AAT), aspartate 1-decarboxylase (ADC), β-alanine aminotransferase (BAAT), aminobutyrate aminotransferase (gabT), 3-HP dehydrogenase (3-HPDH), 3-hydroxyisobutyrate dehydrogenase (HIBADH), and 4-hydroxybutyrate dehydrogenase genes. The 3-HP pathway genes may also include a PEP carboxykinase (PCK) gene that has been modified to produce a polypeptide that preferably catalyzes the conversion of PEP to OAA (native PCK genes generally produce a polypeptide that preferably catalyzes the reverse reaction of OAA to PEP).

In another example, the recombinant cells may have an active 3-HP pathway that proceeds through PEP or pyruvate, OAA, and malonate semialdehyde intermediates (see, e.g., US Pub. No. 2010/0021978, FIG. 1). In these embodiments, the cells comprise a set of 3-HP pathway genes comprising one or more of PPC, PYC, 2-keto acid decarboxylase, alpha-ketoglutarate (AKG) decarboxylase (KG D), branched-chain alpha-keto acid decarboxylase (BCKA), indolepyruvate decarboxylase (IPDA), 3-HPDH, HIBADH, and 4-hydroxybutyrate dehydrogenase genes. The 3-HP pathway genes may also include a PCK gene that has been modified to produce a polypeptide that preferably catalyzes the conversion of PEP to OAA. Further, the 3-HP pathway genes may include a PDC gene and/or benzoylformate decarboxylase gene that has been modified to encode a polypeptide capable of catalyzing the conversion of OAA to malonate semialdehyde.

Figure 2:
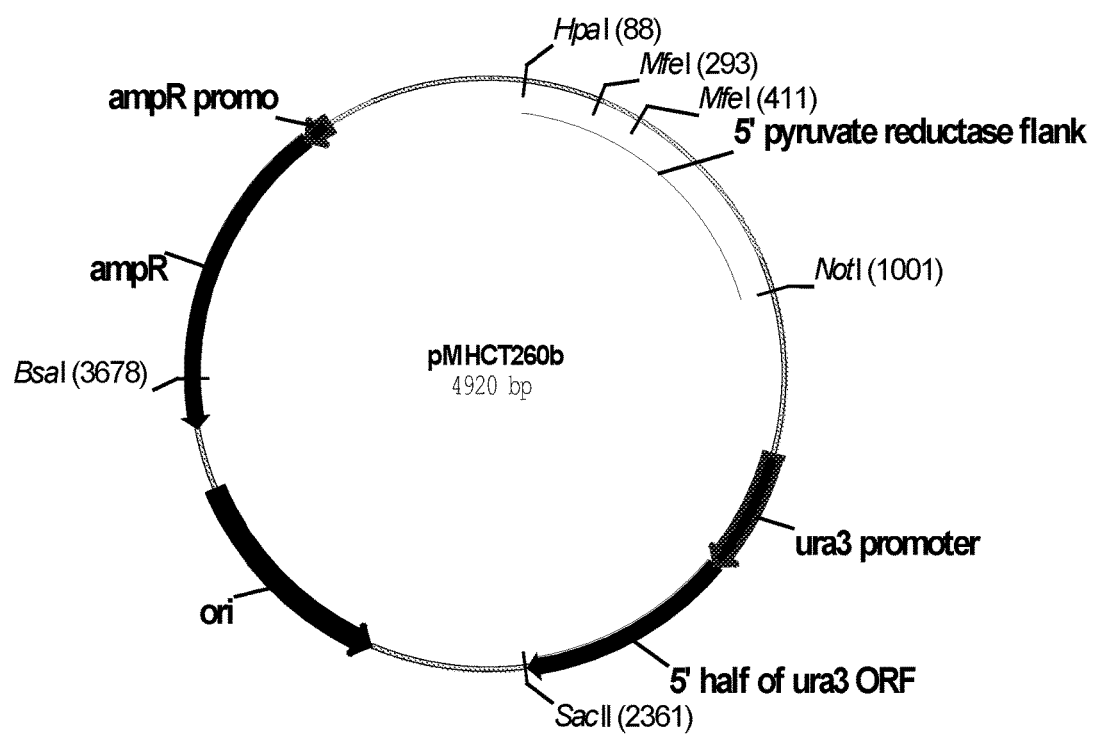
FIG. 2 shows a plasmid map for pMHCT260b.

In another example, the recombinant cells may have an active 3-HP pathway that proceeds through PEP or pyruvate, OAA, malonyl-CoA, and malonate semialdehyde intermediates, wherein the malonate semialdehyde intermediate is optional (see, e.g., US Pub. No. 2010/0021978, FIG. 2). In these embodiments, the cells comprise a set of 3-HP pathway genes comprising one or more of PPC, PYC, OAA formatelyase, malonyl-CoA reductase, CoA acylating malonate semialdehyde dehydrogenase, 3-HPDH, HIBADH, and 4-hydroxybutyrate dehydrogenase genes. The 3-HP pathway genes may also include a PCK gene that has been modified to produce a polypeptide that preferably catalyzes the conversion of PEP to OAA. Further, the 3-HP pathway genes may include an OAA dehydrogenase gene derived by modifying a 2-keto-acid dehydrogenase gene to produce a polypeptide that catalyzes the conversion of OAA to malonyl-CoA.

In another example, the recombinant cells may have an active 3-HP pathway that proceeds through pyruvate, acetyl-CoA, malonyl-CoA, and malonate semialdehyde intermediates, wherein the malonate semialdehyde intermediate is optional (see, e.g., U.S. Pat. No. 7,186,541; FIG. 44). In these embodiments, the cells comprise a set of 3-HP pathway genes comprising one or more of pyruvate dehydrogenase (PDH), acetyl-CoA carboxylase (ACC), malonyl-CoA reductase, CoA acylating malonate semialdehyde dehydrogenase, 3-HPDH, HIBADH, and 4-hydroxybutyrate dehydrogenase genes.

In another example, the recombinant cells may have an active 3-HP pathway that proceeds through pyruvate, alanine, β-alanine, β-alanyl-CoA, acrylyl-CoA, 3-HP-CoA, and malonate semialdehyde intermediates, wherein the β-alanyl-CoA, acrylyl-CoA, 3-HP-CoA, and malonate semialdehyde intermediates are optional (β-alanine can be converted to 3-HP via a malonate semialdehyde intermediate or via β-alanyl-CoA, acrylyl-CoA, and 3-HP-CoA intermediates (see, e.g., U.S. Pat. No. 7,309,597, FIG. 1). In these embodiments, the cells comprise a set of 3-HP pathway genes comprising one or more of alanine dehydrogenase, pyruvate/alanine aminotransferase, alanine 2,3 aminomutase, CoA transferase, CoA synthetase, β-alanyl-CoA ammonia lyase, 3-HP-CoA dehydratase, 3-HP-CoA hydrolase, 3-hydroxyisobutyryl-CoA hydrolase, BAAT, 3-HPDH, HIBADH, and 4-hydroxybutyrate dehydrogenase genes.

Figure 4:
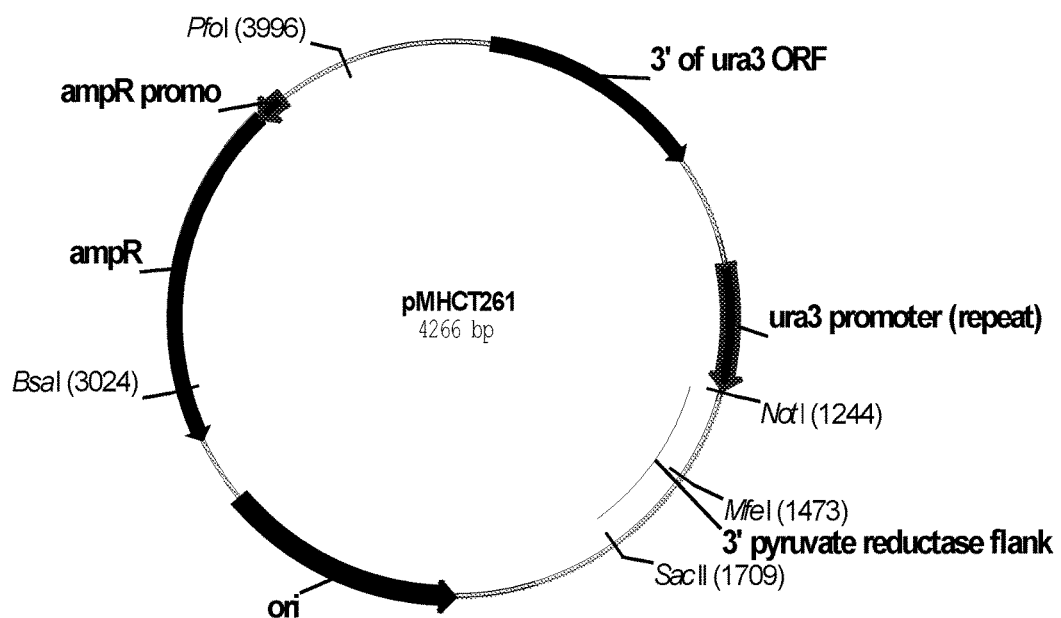
FIG. 4 shows a plasmid map for pMHCT261.

Other pathways that do not utilize a malonate semialdehyde intermediate are also known in the art. For example, the recombinant cells may have an active 3-HP pathway that proceeds through PEP or pyruvate, OAA, and malate intermediates (see, e.g., US Pub. No. 2010/0021978; FIG. 4). In these embodiments, the cells comprise a set of 3-HP pathway genes comprising one or more of PPC, PYC, malate dehydrogenase, and malate decarboxylase genes. The 3-HP pathway genes may also include a PCK gene that has been modified to produce a polypeptide that preferably catalyzes the conversion of PEP to OAA.

In another example, the recombinant cells may have an active 3-HP pathway that proceeds through pyruvate, lactate, lactyl-CoA, acrylyl-CoA, and 3-HP-CoA intermediates (see, e.g., WO02/042418, FIG. 1). In these embodiments, the cells comprise a set of 3-HP pathway genes comprising one or more of LDH, CoA transferase, CoA synthetase, lactyl-CoA dehydratase, 3-HP-CoA dehydratase, 3-HP-CoA hydrolase, and 3-hydroxyisobutyryl-CoA hydrolase genes.

In another example, the recombinant cells may have an active 3-HP pathway that proceeds through glycerol and 3-HPA intermediates (see, e.g., U.S. Pat. No. 6,852,517). In these embodiments, the cells comprise a set of 3-HP pathway genes comprising one or more of glycerol dehydratase and aldehyde dehydrogenase genes.

In another example, the recombinant cells may have an active 3-HP pathway that proceeds through PEP or pyruvate, OAA, aspartate, β-alanine, β-alanyl-CoA, acrylyl-CoA, 3-HP-CoA, and alanine intermediates, wherein the OAA, aspartate, and alanine intermediates are optional (PEP or pyruvate can be converted to β-alanine via OAA and aspartate or via alanine) (see WO02/042418, FIG. 54; U.S. Pat. No. 7,309,597, FIG. 1). In these embodiments, the cells comprise a set of 3-HP pathway genes comprising one or more of PPC, PYC, AAT, ADC, CoA transferase, CoA synthetase, β-alanyl-CoA ammonia lyase, 3-HP-CoA dehydratase, 3-HP-CoA hydrolase, 3-hydroxyisobutyrl-CoA hydrolase, alanine dehydrogenase, pyruvate/alanine aminotransferase, and AAM genes. The 3-HP pathway genes may also include a PCK gene that has been modified to produce a polypeptide that preferably catalyzes the conversion of PEP to OAA.

In certain embodiments, the recombinant cells provided herein express one or more 3-HP pathway genes encoding enzymes selected from the group consisting of ACC (catalyzes the conversion of acetyl-CoA to malonyl-CoA), alanine 2,3 aminomutase (AAM, catalyzes the conversion of alanine to β-alanine), alanine dehydrogenase (catalyzes the conversion of pyruvate to alanine), aldehyde dehydrogenase (catalyzes the conversion of 3-HPA to 3-HP), KGD (catalyzes the conversion of OAA to malonate semialdehyde), AAT (catalyzes the conversion of OAA to aspartate), ADC (catalyzes the conversion of aspartate to β-alanine), BCKA (catalyzes the conversion of OAA to malonate semialdehyde), BAAT (catalyzes the conversion of β-alanine to malonate semialdehyde), 4-aminobutyrate aminotransferase (gabT, catalyzes the conversion of β-alanine to malonate semialdehyde), β-alanyl-CoA ammonia lyase (catalyzes the conversion of β-alanyl-CoA to acrylyl-CoA), Co-A acylating malonate semialdehyde dehydrogenase (catalyzes the conversion of malonyl-CoA to malonate semialdehyde), CoA synthetase (catalyzes the conversion of β-alanine to β-alanyl-CoA or the conversion of lactate to lactyl-CoA), CoA transferase (catalyzes the conversion of β-alanine to β-alanyl-CoA and/or the conversion of lactate to lactyl-CoA), glycerol dehydratase (catalyzes the conversion of glycerol to 3-HPA), IPDA (catalyzes the conversion of OAA to malonate semialdehyde), LDH (catalyzes the conversion of pyruvate to lactate), lactyl-CoA dehydratase (catalyzes the conversion of lactyl-CoA to acrylyl-CoA), malate decarboxylase (catalyzes the conversion of malate to 3-HP), malate dehydrogenase (catalyzes the conversion of OAA to malate), malonyl-CoA reductase (catalyzes the conversion of malonyl-CoA to malonate semialdehyde or 3-HP), OAA formatelyase (also known as pyruvate-formate lyase and ketoacid formate-lyase, catalyzes the conversion of OAA to malonyl-CoA), OAA dehydrogenase (catalyzes the conversion of OAA to malonyl CoA); PPC (catalyzes the conversion of PEP to OAA), pyruvate/alanine aminotransferase (catalyzes the conversion of pyruvate to alanine), PYC (catalyzes the conversion of pyruvate to OAA), PDH (catalyzes the conversion of pyruvate to acetyl-CoA), 2-keto acid decarboxylase (catalyzes the conversion of OAA to malonate semialdehyde), 3-HP-CoA dehydratase (also known as acrylyl-CoA hydratase, catalyzes the conversion of acrylyl-CoA to 3-HP-CoA), 3-HPDH (catalyzes the conversion of malonate semialdehyde to 3-HP), 3-HP-CoA hydrolase (catalyzes the conversion of 3-HP-CoA to 3-HP), HIBADH (catalyzes the conversion of malonate semialdehyde to 3-HP), 3-hydroxyisobutyryl-CoA hydrolase (catalyzes the conversion of 3-HP-CoA to 3-HP), and 4-hydroxybutyrate dehydrogenase (catalyzes the conversion of malonate semialdehyde to 3-HP). For each of these enzyme activities, the reaction of interest in parentheses may be a result of endogenous or heterologous activity.

Any suitable 3-HP pathway gene, endogenous or heterologous, may be used and expressed in sufficient amount to produce an enzyme involved in a selected active 3-HP pathway. With the complete genome sequence available for now more than 550 species (with more than half of these available on public databases such as the NCBI), including 395 microorganism genomes and a variety of yeast, fungi, plant, and mammalian genomes, the identification of genes encoding the selected 3-HP pathway enzymatic activities taught herein is routine and well known in the art for a selected host. For example, suitable homologues, orthologs, paralogs and nonorthologous gene displacements of known genes, and the interchange of genetic alterations between organisms can be identified in related or distant host to a selected host.

For recombinant cells without a known genome sequence, sequences for genes of interest (either as overexpression candidates or as insertion sites) can typically be obtained using techniques known in the art. Routine experimental design can be employed to test expression of various genes and activity of various enzymes, including genes and enzymes that function in a 3-HP pathway. Experiments may be conducted wherein each enzyme is expressed in the cell individually and in blocks of enzymes up to and including preferably all pathway enzymes, to establish which are needed (or desired) for improved 3-HP production. One illustrative experimental design tests expression of each individual enzyme as well as of each unique pair of enzymes, and further can test expression of all required enzymes, or each unique combination of enzymes. A number of approaches can be taken, as will be appreciated.

The recombinant host cells of the invention can be produced by introducing heterologous polynucleotides encoding one or more of the enzymes participating in a 3-HP pathway, as described below. As one in the art will appreciate, in some instances (e.g., depending on the selection of host) the heterologous expression of every gene shown in the 3-HP pathway may not be required for 3-HP production since a host cell may have endogenous enzymatic activity from one or more pathway genes. For example, if a chosen host is deficient in one or more enzymes of a 3-HP pathway, then heterologous polynucleotides for the deficient enzyme(s) are introduced into the host for subsequent expression. Alternatively, if the chosen host exhibits endogenous expression of some pathway genes, but is deficient in others, then an encoding polynucleotide is needed for the deficient enzyme(s) to achieve 3-HP biosynthesis. Thus, a recombinant host cell of the invention can be produced by introducing heterologous polynucleotides to obtain the enzyme activities of a desired biosynthetic pathway or a desired biosynthetic pathway can be obtained by introducing one or more heterologous polynucleotides that, together with one or more endogenous enzymes, produces a desired product such as 3-HP.

Depending on the 3-HP pathway constituents of a selected recombinant host organism, the host cells of the invention will include at least one heterologous polynucleotide and optionally up to all encoding heterologous polynucleotides for the 3-HP pathway. For example, 3-HP biosynthesis can be established in a host deficient in a 3-HP pathway enzyme through heterologous expression of the corresponding polynucleotide. In a host deficient in all enzymes of a 3-HP pathway, heterologous expression of all enzymes in the pathway can be included, although it is understood that all enzymes of a pathway can be expressed even if the host contains at least one of the pathway enzymes.

A "pyruvate carboxylase gene" or "PYC gene" as used herein refers to any gene that encodes a polypeptide with pyruvate carboxylase activity, meaning the ability to catalyze the conversion of pyruvate, $CO_2$, and ATP to OAA, ADP, and phosphate. In certain embodiments, a PYC gene may be derived from a yeast source. For example, the PYC gene may be derived from an *I. orientalis* PYC gene encoding the amino acid sequence set forth in SEQ ID NO: 2. In other embodiments, the gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 2. In certain embodiments, an *I. orientalis*-derived PYC gene may comprise the nucleotide sequence set forth in SEQ ID NO: 1 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 1. In other embodiments, the PYC gene may be derived from a bacterial source. For example, the PYC gene may be derived from one of the few bacterial species that use only PYC and not PPC (see below) for anaplerosis, such as *R. sphaeroides*, or from a bacterial species that possesses both PYC and PPC, such as *R. etli*. The amino acid sequences encoded by the PYC genes of *R. sphaeroides* and *R. etli* are set forth in SEQ ID NOs: 3 and 4, respectively. A PYC gene may be derived from a gene encoding the amino acid sequence of SEQ ID NOs: 3 or 4, or from a gene encoding an amino acid sequence with at least 50%, at least 60%, at least 70%, at least 80%, at least 85%, at least 90%, at least 95%, at least 97%, or at least 99% sequence identity to the amino acid sequence of SEQ ID NOs: 3 or 4. Alternatively, the PYC gene may be derived from a PYC gene encoding an enzyme that does not have a dependence on acetyl-CoA for activation, such as a *P. fluorescens* PYC gene encoding the amino acid sequence set forth in SEQ ID NO: 5 (carboxytransferase subunit) or SEQ ID NO: 6 (biotin carboxylase subunit), a *C. glutamicum* PYC gene of encoding the amino acid sequence set forth in SEQ ID NO: 7, or a gene encoding an amino acid sequence with at least 50%, at least 60%, at least 70%, at least 80%, at least 85%, at least 90%, at least 95%, at least 97%, or at least 99% sequence identity to the amino acid sequence of SEQ ID NOs: 5, 6, or 7. A PYC gene may also be derived from a PYC gene that encodes an enzyme that is not inhibited by aspartate, such as an *S. meliloti* PYC gene encoding the amino acid sequence set forth in SEQ ID NO: 8 (Sauer FEMS Microbiol Rev 29:765 (2005), or from a gene encoding an amino acid sequence with at least 50%, at least 60%, at least 70%, at least 80%, at least 85%, at least 90%, at least 95%, at least 97%, or at least 99% sequence identity to the amino acid sequence of SEQ ID NO: 8.

A "PEP carboxylase gene" or "PPC gene" as used herein refers to any gene that encodes a polypeptide with PEP carboxylase activity, meaning the ability to catalyze the conversion of PEP and $CO_2$ to OAA and phosphate. In certain embodiments, a PPC gene may be derived from a bacterial PPC gene. For example, the PPC gene may be derived from an *E. coli* PPC gene encoding the amino acid sequence set forth in SEQ ID NO: 10 or an amino acid sequence with at least 50%, at least 60%, at least 70%, at least 80%, at least 85%, at least 90%, at least 95%, at least 97%, or at least 99% sequence identity to the amino acid sequence of SEQ ID NO: 10. In certain embodiments, an *E. coli*-derived PPC gene may comprise the nucleotide sequence set forth in SEQ ID NO: 9 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 9. In other embodiments, a PPC gene may be derived from an "A" type PPC, found in many archea and a limited number of bacteria, that is not activated by acetyl CoA and is less inhibited by aspartate. For example, a PPC gene may be derived from an *M. thermoautotrophicum* PPC A gene encoding the amino acid sequence set forth in SEQ ID NO: 11, a *C. perfringens* PPC A gene encoding the amino acid sequence set forth in SEQ ID NO: 12, or a gene encoding an amino acid sequence with at least 50%, at least 60%, at least 70%, at least 80%, at least 85%, at least 90%, at least 95%, at least 97%, or at least 99% sequence identity to the amino acid sequence of SEQ ID NOs: 11 or 12. In certain of these embodiments, the gene may have undergone one or more mutations versus the native gene in order to generate an enzyme with improved characteristics. For example, the gene may have been mutated to encode a PPC polypeptide with increased resistance to aspartate feedback versus the native polypeptide. In other embodiments, the PPC gene may be derived from a plant source.

An "aspartate aminotransferase gene" or "AAT gene" as used herein refers to any gene that encodes a polypeptide with aspartate aminotransferase activity, meaning the ability to catalyze the conversion of OAA to aspartate. Enzymes having aspartate aminotransferase activity are classified as EC 2.6.1.1. In certain embodiments, an AAT gene may be derived from a yeast source such as *I. orientalis* or *S. cerevisiae*. For example, the AAT gene may be derived from an *I. orientalis* AAT gene encoding the amino acid sequence set forth in SEQ ID NO: 14 or an *S. cerevisiae* AAT2 gene encoding the amino acid sequence set forth in SEQ ID NO: 15. In other embodiments, the gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NOs: 14 or 15. In certain embodiments, an *I. orientalis*-derived AAT gene may comprise the nucleotide sequence set forth in SEQ ID NO: 13 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 13. In other embodiments, the AAT gene may be derived from a bacterial source. For example, the AAT gene may be derived from an *E. coli* aspC gene encoding a polypeptide comprising the amino acid sequence set forth in SEQ ID NO: 16. In other embodiments, the gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 16.

An "aspartate decarboxylase gene" or "ADC gene" as used herein refers to any gene that encodes a polypeptide with aspartate decarboxylase activity, meaning the ability to catalyze the conversion of aspartate to β-alanine. Enzymes having aspartate decarboxylase activity are classified as EC 4.1.1.11. In certain embodiments, an ADC gene may be derived from a bacterial source.

In some embodiments, the ADC gene may be derived from an *S. avermitilis* panD gene encoding the amino acid sequence set forth in SEQ ID NO: 17. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 17. In certain embodiments, an *S. avermitilis*-derived ADC gene may comprise the nucleotide sequence set forth in any one of SEQ ID NOs: 130, 145, 146, or 147; or a nucleotide sequence with at least 50%, at least 60%, at least 70%, at least 80%, at least 85%, at least 90%, at least 95%, at least 97%, or at least 99% sequence identity to the nucleotide sequence set forth in any one of SEQ ID NOs: 130, 145, 146, or 147.

In other embodiments, the ADC gene may be derived from a *C. acetobutylicum* panD gene encoding the amino acid sequence set forth in SEQ ID NO: 18. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 18. In certain embodiments, a *C. acetobutylicum*-derived ADC gene may comprise the nucleotide sequence set forth in SEQ ID NO: 131, or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 131.

In other embodiments, the ADC gene may be derived from a *H. pylori* ADC gene encoding the amino acid sequence set forth in SEQ ID NO: 133. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 133. In certain embodiments, a *H. pylori*-derived ADC gene may comprise the nucleotide sequence set forth in SEQ ID NO: 133, or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 133.

In other embodiments, the ADC gene may be derived from a *Bacillus* sp. TS25 ADC gene encoding the amino acid sequence set forth in SEQ ID NO: 135. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 135. In certain embodiments, a *Bacillus* sp. TS25-derived ADC gene may comprise the nucleotide sequence set forth in SEQ ID NO: 134, or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 134.

In other embodiments, the ADC gene may be derived from a *C. glutamicum* ADC gene encoding the amino acid sequence set forth in SEQ ID NO: 137. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 137. In certain embodiments, a *C. glutamicum*-derived ADC gene may comprise the nucleotide sequence set forth in SEQ ID NO: 136, or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 136.

In other embodiments, the ADC gene may be derived from a *B. licheniformis* ADC gene encoding the amino acid sequence set forth in SEQ ID NO: 139. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 139. In certain embodiments, a *B. licheniformis*-derived ADC gene may comprise the nucleotide sequence set forth in any one of SEQ ID NOs: 138, 148, 149, 150, or 151; or a nucleotide sequence with at least 50%, at least 60%, at least 70%, at least 80%, at least 85%, at least 90%, at least 95%, at least 97%, or at least 99% sequence identity to the nucleotide sequence set forth in any one of SEQ ID NOs: 138, 148, 149, 150, or 151.

In other embodiments, the ADC gene may be derived from the Class Insecta (insect) ADC gene, e.g., as described in WO 2015/017721 (the content of which is incorporated herein by reference). For example, in some embodiments, the ADC gene may encode an amino acid sequence of the *Aedes aegypti* ADC of SEQ ID NO: 162, the *Culex quinquefasciatus* ADC of SEQ ID NO: 163, the *Anopheles gambiae* ADC of SEQ ID NO: 164, the *Tribolium castaneum* ADC of SEQ ID NO: 165, the *Attagenus smirnovi* ADC of SEQ ID NO: 166, the *Acyrthosiphon pisum* ADC of SEQ ID NO: 167, the *Drosophila sechellia* ADC of SEQ ID NO: 168, the *Drosophila melanogaster* ADC of SEQ ID NO: 169, the *Danaus plexippus* ADC of SEQ ID NO: 170, the *Drosophila yakuba* ADC of SEQ ID NO: 171, the *Drosophila erecta* ADC of SEQ ID NO: 172, the *Papilio xuthus* ADC of SEQ ID NO: 173, the *Drosophila persimilis* ADC of SEQ ID NO: 174, the *Bombyx mori* ADC of SEQ ID NO: 175, the *Drosophila ananassae* ADC of SEQ ID NO: 176, the *Drosophila mojavensis* ADC of SEQ ID NO: 177, the *Drosophila grimshawi* ADC of SEQ ID NO: 178, the *Biston betularia* ADC of SEQ ID NO: 179, the *Drosophila willistoni* ADC of SEQ ID NO: 180, the *Apis mellifera* ADC of SEQ ID NO: 181, the *Drosophila virilis* ADC of SEQ ID NO: 182, the *Nasonia vitripennis* ADC of SEQ ID NO: 183, the *Bicyclus anynana* ADC of SEQ ID NO: 184, the *Harpegnathos saltator* ADC of SEQ ID NO: 185, the *Acromyrmex echinatior* ADC of SEQ ID NO: 186, the *Camponotus floridanus* ADC of SEQ ID NO: 187, the *Pediculus humanus* ADC of SEQ ID NO: 188, the *Atta cephalotes* ADC of SEQ ID NO: 189, the *Meligethes aeneus* ADC of SEQ ID NO: 190, or the *Solenopsis invicta* ADC of SEQ ID NO: 191. In another aspect is a recombinant cell comprising an aspartate 1-decarboxylase (ADC) of the Class Bivalvia, Branchiopoda, Gastropoda, or Leptocardii, such as the *Daphnia pulex* ADC of SEQ ID NO: 192, the *Lottia gigantea* ADC of SEQ ID NO: 193, the *Branchiostoma floridae* ADC of SEQ ID NO: 194, or the *Crassostrea gigas* ADC of SEQ ID NO: 195. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of any one of SEQ ID NOs: 162-195.

A "β-alanine aminotransferase gene" or "BAAT gene" as used herein refers to any gene that encodes a polypeptide with β-alanine aminotransferase activity, meaning the ability to catalyze the conversion of β-alanine to malonate semialdehyde. Enzymes having β-alanine aminotransferase activity are classified as EC 2.6.1.19. In certain embodiments, a BAAT gene may be derived from a yeast source. For example, a BAAT gene may be derived from the *I. orientalis* homolog to the pyd4 gene encoding the amino acid sequence set forth in SEQ ID NO: 20. In some embodiments, the BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 20. In certain embodiments, an *I. orientalis*-derived BAAT gene may comprise the nucleotide sequence set forth in SEQ ID NO: 19 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 19. In other embodiments, the BAAT gene may be derived from the *S. kluyveri* pyd4 gene encoding the amino acid sequence set forth in SEQ ID NO: 21. In some embodiments, the BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 21. In certain embodiments, a *S. kluyveri*-derived BAAT gene may comprise the nucleotide sequence set forth in SEQ ID NO: 142 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 142. In other embodiments, the BAAT gene may be derived from a bacterial source. For example, a BAAT gene may be derived from an *S. avermitilis* BAAT gene encoding the amino acid sequence set forth in SEQ ID NO: 22. In some embodiments, the BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 22. In certain embodiments, a *S. avermitilis*-derived BAAT gene may comprise the nucleotide sequence set forth in SEQ ID NO: 140 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 140.

A BAAT gene may also be a "4-aminobutyrate aminotransferase" or "gabT gene" meaning that it has native activity on 4-aminobutyrate as well as β-alanine. Alternatively, a BAAT gene may be derived by random or directed engineering of a native gabT gene from a bacterial or yeast source to encode a polypeptide with BAAT activity. For example, a BAAT gene may be derived from the *S. avermitilis* gabT encoding the amino acid sequence set forth in SEQ ID NO: 23. In some embodiments, the *S. avermitilis*-derived BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 23. In other embodiments, a BAAT gene may be derived from the *S. cerevisiae* gabT gene UGA1 encoding the amino acid sequence set forth in SEQ ID NO: 24. In some embodiments, the *S. cerevisiae*-derived BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 24. In certain embodiments, an *S. cerevisiae*-derived BAAT gene may comprise the nucleotide sequence set forth in SEQ ID NO: 141 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 141.

In certain embodiments, the 3-HPDH gene may be derived from a yeast source. For example, the 3-HPDH gene may be derived from the *I. orientalis* homolog to the YMR226C gene encoding the amino acid sequence set forth in SEQ ID NO: 26. In some embodiments, the 3-HPDH gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 26. In certain embodiments, the *I. orientalis*-derived 3-HPDH gene may comprise the nucleotide sequence set forth in SEQ ID NO: 25 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 25. In other embodiments, the 3-HPDH gene may be derived from the *S. cerevisiae* YMR226C gene encoding the amino acid sequence set forth in SEQ ID NO: 129. In some embodiments, the 3-HPDH gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 129. In certain embodiments, the *S. cerevisiae*-derived 3-HPDH gene may comprise the nucleotide sequence set forth in SEQ ID NO: 144 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 144. In other embodiments, the 3-HPDH gene may encode an amino acid sequence with at least 50%, at least 60%, at least 70%, at least 80%, at least 85%, at least 90%, at least 95%, at least 97%, or at least 99% sequence identity to the *Candida parapsilosis* amino acid sequence of SEQ ID NO: 197. In other embodiments, the 3-HPDH gene may encode an amino acid sequence with at least 50%, at least 60%, at least 70%, at least 80%, at least 85%, at least 90%, at least 95%, at least 97%, or at least 99% sequence identity to the *Debaryomyces hansenii* amino acid sequence of SEQ ID NO: 199. In other embodiments, the 3-HPDH gene may encode an amino acid sequence with at least 50%, at least 60%, at least 70%, at least 80%, at least 85%, at least 90%, at least 95%, at least 97%, or at least 99% sequence identity to the *Meyerozyma guilliermondii* amino acid sequence of SEQ ID NO: 201. In other embodiments, the 3-HPDH gene may encode an amino acid sequence with at least 50%, at least 60%, at least 70%, at least 80%, at least 85%, at least 90%, at least 95%, at least 97%, or at least 99% sequence identity to the *Meyerozyma guilliermondii* amino acid sequence of SEQ ID NO: 203.

In other embodiments, the 3-HPDH gene may be derived from a bacterial source. For example, a 3-HPDH gene may be derived from an *E. coli* ydfG gene encoding the amino acid sequence in SEQ ID NO: 27. In some embodiments, the 3-HPDH gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 27. In certain embodiments, the *E. coli*-derived 3-HPDH gene may comprise the nucleotide sequence set forth in SEQ ID NO: 143 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 143. In other embodiments, the 3-HPDH gene may be derived from an *M. sedula* malonate semialdehyde reductase gene encoding the amino acid sequence set forth in SEQ ID NO: 29. In some embodiments, the 3-HPDH gene may encode an amino acid sequence with at least 50%, at least 60%, at least 70%, at least 80%, at least 85%, at least 90%, at least 95%, at least 97%, or at least 99% sequence identity to the amino acid sequence set forth in SEQ ID NO: 29. In certain embodiments, the *M. sedula*-derived 3-HPDH gene may comprise the nucleotide sequence set forth in SEQ ID NO: 152 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 152.

In certain embodiments, the 3-HPDH gene may be a natural or engineered gene having an increased specificity for NAD(H) compared to NADP(H). 3-HPDA variants having increased specificity for NAD(H) are described in WO 2013/049073 (the content of which is incorporated herein by reference).

A "3-hydroxyisobutyrate dehydrogenase gene" or "HIBADH gene" as used herein refers to any gene that encodes a polypeptide with 3-hydroxyisobutyrate dehydrogenase activity, meaning the ability to catalyze the conversion of 3-hydroxyisobutyrate to methylmalonate semialdehyde. Enzymes having 3-hydroxyisobutyrate dehydrogenase activity are classified as EC 1.1.1.31. Some 3-hydroxyisobutyrate dehydrogenases also have 3-HPDH activity. In certain embodiments, an HIBADH gene may be derived from a bacterial source. For example, an HIBADH gene may be derived from an *A. faecalis* M3A gene encoding the amino acid sequence set forth in SEQ ID NO: 28, a *P. putida* KT2440 or E23440 mmsB gene encoding the amino acid sequence set forth in SEQ ID NO: 30 or SEQ ID NO: 31, respectively, or a *P. aeruginosa* PAO1 mmsB gene encoding the amino acid sequence set forth in SEQ ID NO: 32. In certain embodiments, an HIBADH gene may encode an amino acid sequence with at least 50%, at least 60%, at least 70%, at least 80%, at least 85%, at least 90%, at least 95%, at least 97%, or at least 99% sequence identity to the amino acid sequence set forth in SEQ ID NOs: 28, 30, 31, or 32.

A "4-hydroxybutyrate dehydrogenase gene" as used herein refers to any gene that encodes a polypeptide with 4-hydroxybutyrate dehydrogenase activity, meaning the ability to catalyze the conversion of 4-hydroxybutanoate to succinate semialdehyde. Enzymes having 4-hydroxybutyrate dehydrogenase activity are classified as EC 1.1.1.61. Some 4-hydroxybutyrate dehydrogenases also have 3-HPDH activity. In certain embodiments, a 4-hydroxybutyrate dehydrogenase gene may be derived from a bacterial source. For example, a 4-hydroxybutyrate dehydrogenase gene may be derived from a *R. eutropha* H16 4hbd gene encoding the amino acid sequence set forth in SEQ ID NO: 33 or a *C. kluyveri* DSM 555 hbd gene encoding the amino acid sequence set forth in SEQ ID NO: 34. In other embodiments, the gene may encode an amino acid sequence with at least 50%, at least 60%, at least 70%, at least 80%, at least 85%, at least 90%, at least 95%, at least 97%, or at least 99% sequence identity to the amino acid sequence set forth in SEQ ID NOs: 33 or 34.

A "PEP carboxykinase gene" or "PCK gene" as used herein refers to any gene that encodes a polypeptide with PEP carboxykinase activity, meaning the ability to catalyze the conversion of PEP, $CO_2$, and ADP or GDP to OAA and ATP or GTP, or vice versa. Enzymes having PEP carboxykinase activity are classified as EC 4.1.1.32 (GTP/GDP utilizing) and EC 4.1.1.49 (ATP/ADP utilizing). In certain embodiments, a PCK gene may be derived from a yeast source. In other embodiments, a PCK gene may be derived from a bacterial source, and in certain of these embodiments the gene may be derived from a bacteria in which the PCK reaction favors the production of OAA rather than the more common form of the reaction where decarboxylation is dominant. For example, a PCK gene may be derived from an *M. succiniciproducens* PCK gene encoding the amino acid sequence set forth in SEQ ID NO: 35, an *A. succiniciproducens* PCK gene encoding the amino acid sequence set forth in SEQ ID NO: 36, an *A. succinogenes* PCK gene encoding the amino acid sequence set forth in SEQ ID NO: 37, or an *R. eutropha* PCK gene encoding the amino acid sequence set forth in SEQ ID NO: 38. In other embodiments, a PCK gene has undergone one or more mutations versus the native gene from which it was derived, such that the resultant gene encodes a polypeptide that preferably catalyzes the conversion of PEP to OAA. For example, a PCK gene may be derived from an *E. coli* K12 strain PCK gene encoding the amino acid sequence set forth in SEQ ID NO: 39, where the gene has been mutated to preferably catalyze the conversion of PEP to OAA. In other embodiments the conversion of PEP to OAA is catalyzed by a PEP carboxytransphosphorylase such as is found in propionic acid bacteria (e.g., *P. shermanii, A. woodii*) which use inorganic phosphate and diphosphate rather than ATP/ADP or GTP/GDP.

A "malate dehydrogenase gene" as used herein refers to any gene that encodes a polypeptide with malate dehydrogenase activity, meaning the ability to catalyze the conversion of OAA to malate. In certain embodiments, a malate dehydrogenase gene may be derived from a bacterial or yeast source.

A "malate decarboxylase gene" as used herein refers to any gene that encodes a polypeptide with malate decarboxylase activity, meaning the ability to catalyze the conversion of malate to 3-HP. Malate decarboxylase activity is not known to occur naturally. Therefore, a malate decarboxylase gene may be derived by incorporating one or more mutations into a native source gene that encodes a polypeptide with acetolactate decarboxylase activity. Polypeptides with acetolactate decarboxylase activity catalyze the conversion of 2-hydroxy-2-methyl-3-oxobutanoate to 2-acetoin, and are classified as EC 4.1.1.5. In certain embodiments, a malate decarboxylase gene may be derived from a bacterial source. For example, a malate decarboxylase gene may be derived from an *L. lactis* aldB gene encoding the amino acid sequence set forth in SEQ ID NO: 40, an *S. thermophilus* aldB gene encoding the amino acid sequence set forth in SEQ ID NO: 41, a *B. brevis* aldB gene encoding the amino acid sequence set forth in SEQ ID NO: 42, or a *E. aerogenes* budA gene encoding the amino acid sequence set forth in SEQ ID NO: 43.

An "alpha-ketoglutarate (AKG) decarboxylase gene" or "KGD gene" as used herein refers to any gene that encodes a polypeptide with alpha-ketoglutarate decarboxylase activity, meaning the ability to catalyze the conversion of alpha-ketoglutarate (2-oxoglutarate) to succinate semialdehyde. Enzymes having AKG decarboxylase activity are classified as EC 4.1.1.71. A KGD gene may be used to derive a gene encoding a polypeptide capable of catalyzing the conversion of OAA to malonate semialdehyde. This activity may be found in a native KGD gene, or it may derived by incorporating one or more mutations into a native KGD gene. In certain embodiments, a KGD gene may be derived from a bacterial source. For example, a KGD gene may be derived from a *M. tuberculosis* KGD gene encoding the amino acid sequence set forth in SEQ ID NO: 44, a *B. japonicum* KGD gene encoding the amino acid sequence set forth in SEQ ID NO: 45, or a *M. loti* (aka *Rhizobium loti*) KGD gene encoding the amino acid sequence set forth in SEQ ID NO: 46.

A "branched-chain alpha-keto acid decarboxylase gene" or "BCKA gene" as used herein refers to any gene that encodes a polypeptide with branched-chain alpha-keto acid decarboxylase activity, which can serve to decarboxylate a range of alpha-keto acids from three to six carbons in length. Enzymes having BCKA activity are classified as EC 4.1.1.72. A BCKA gene may be used to derive a gene encoding a polypeptide capable of catalyzing the conversion of OAA to malonate semialdehyde. This activity may be found in a native BCKA gene, or it may be derived by incorporating one or more mutations into a native BCKA gene. In certain embodiments, a BCKA gene may be derived from a bacterial source. For example, a BCKA gene may be derived from a *L. lactis* kdcA gene encoding the amino acid sequence set forth in SEQ ID NO: 47.

An "indolepyruvate decarboxylase gene" or "IPDA gene" as used herein refers to any gene that encodes a polypeptide with indolepyruvate decarboxylase activity, meaning the ability to catalyze the conversion of indolepyruvate to indoleacetaldehyde. Enzymes having IPDA activity are classified as EC 4.1.1.74. An IPDA gene may be used to derive a gene encoding a polypeptide capable of catalyzing the conversion of OAA to malonate semialdehyde. This activity may be found in a native IPDA gene, or it may be derived by incorporating one or more mutations into a native IPDA gene. In certain embodiments, an indolepyruvate decarboxylase gene may be derived from a yeast, bacterial, or plant source.

A "pyruvate decarboxylase gene" or "PDC gene" as used herein refers to any gene that encodes a polypeptide with pyruvate decarboxylase activity, meaning the ability to catalyze the conversion of pyruvate to acetaldehyde. Enzymes having PDC activity are classified as EC 4.1.1.1. In preferred embodiments, a PDC gene that is incorporated into a recombinant cell as provided herein has undergone one or more mutations versus the native gene from which it was derived such that the resultant gene encodes a polypeptide capable of catalyzing the conversion of OAA to malonate semialdehyde. In certain embodiments, a PDC gene may be derived from a yeast source. For example, a PDC gene may be derived from an *I. orientalis* PDC gene encoding the amino acid sequence set forth in SEQ ID NO: 49, an *S. cerevisiae* PDC1 gene encoding the amino acid sequence set forth in SEQ ID NO: 50, or a *K. lactis* PDC encoding the amino acid sequence set forth in SEQ ID NO: 51. In certain embodiments, a PDC gene derived from the *I. orientalis* PDC gene may comprise the nucleotide sequence set forth in SEQ ID NO: 48 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 48. In other embodiments, a PDC gene may be derived from a bacterial source. For example, a PDC gene may be derived from a *Z. mobilis* PDC gene encoding the amino acid sequence set forth in SEQ ID NO: 52 or an *A. pasteurianus* PDC gene encoding the amino acid sequence set forth in SEQ ID NO: 53.

A "benzoylformate decarboxylase" gene as used herein refers to any gene that encodes a polypeptide with benzoylformate decarboxylase activity, meaning the ability to catalyze the conversion of benzoylformate to benzaldehyde. Enzymes having benzoylformate decarboxylase activity are classified as EC 4.1.1.7. In preferred embodiments, a benzoylformate decarboxylase gene that is incorporated into a recombinant cell as provided herein has undergone one or more mutations versus the native gene from which it was derived such that the resultant gene encodes a polypeptide capable of catalyzing the conversion of OAA to malonate semialdehyde. In certain embodiments, a benzoylformate decarboxylase gene may be derived from a bacterial source. For example, a benzoylformate decarboxylase gene may be derived from a *P. putida* mdlC gene encoding the amino acid sequence set forth in SEQ ID NO: 54, a *P. aeruginosa* mdlC gene encoding the amino acid sequence set forth in SEQ ID NO: 55, a *P. stutzeri* dpgB gene encoding the amino acid sequence set forth in SEQ ID NO: 56, or a *P. fluorescens* ilvB-1 gene encoding the amino acid sequence set forth in SEQ ID NO: 57.

An "OAA formatelyase gene" as used herein refers to any gene that encodes a polypeptide with OAA formatelyase activity, meaning the ability to catalyze the conversion of an acylate ketoacid to its corresponding CoA derivative. A polypeptide encoded by an OAA formatelyase gene may have activity on pyruvate or on another ketoacid. In certain embodiments, an OAA formatelyase gene encodes a polypeptide that converts OAA to malonyl-CoA.

A "malonyl-CoA reductase gene" as used herein refers to any gene that encodes a polypeptide with malonyl-CoA reductase activity, meaning the ability to catalyze the conversion of malonyl-CoA to malonate semialdehyde (also referred to as Co-A acylating malonate semialdehyde dehydrogenase activity). In certain embodiments, a malonyl-CoA reductase gene may be derived from a bifunctional malonyl-CoA reductase gene which also has the ability to catalyze the conversion of malonate semialdehyde to 3-HP. In certain of these embodiments, a malonyl-CoA reductase gene may be derived from a bacterial source. For example, a malonyl-CoA reductase gene may be derived from a *C. aurantiacus* malonyl-CoA reductase gene encoding the amino acid sequence set forth in SEQ ID NO: 58, an *R. castenholzii* malonyl-CoA reductase gene encoding the amino acid sequence set forth in SEQ ID NO: 59, or an *Erythrobacter* sp. NAP1 malonyl-CoA reductase gene encoding the amino acid sequence set forth in SEQ ID NO: 60. In other embodiments, a malonyl-CoA reductase gene may be derived from a malonyl-CoA reductase gene encoding a polypeptide that only catalyzes the conversion of malonyl-CoA to malonate semialdehyde. For example, a malonyl-CoA reductase gene may be derived from an *M. sedula* Msed_0709 gene encoding the amino acid sequence set forth in SEQ ID NO: 61 or a *S. tokodaii* malonyl-CoA reductase encoding the amino acid sequence set forth in SEQ ID NO: 62.

A "pyruvate dehydrogenase gene" or "PDH gene" as used herein refers to any gene that encodes a polypeptide with pyruvate dehydrogenase activity, meaning the ability to catalyze the conversion of pyruvate to acetyl-CoA. In certain embodiments, a PDH gene may be derived from a yeast source. For example, a PDH gene may be derived from an *S. cerevisiae* LAT1, PDA1, PDB1, or LPD gene encoding the amino acid sequence set forth in SEQ ID NOs: 63-66, respectively. In other embodiments, a PDH gene may be derived from a bacterial source. For example, a PDH gene may be derived from an *E. coli* strain K12 substr. MG1655 aceE, aceF, or lpd gene encoding the amino acid sequence set forth in SEQ ID NOs: 67-69, respectively, or a *B. subtilis* pdhA, pdhB, pdhC, or pdhD gene encoding the amino acid sequence set forth in SEQ ID NOs: 70-73, respectively.

An "acetyl-CoA carboxylase gene" or "ACC gene" as used herein refers to any gene that encodes a polypeptide with acetyl-CoA carboxylase activity, meaning the ability to catalyze the conversion of acetyl-CoA to malonyl-CoA. Enzymes having acetyl-CoA carboxylase activity are classified as EC 6.4.1.2. In certain embodiments, an acetyl-CoA carboxylase gene may be derived from a yeast source. For example, an acetyl-CoA carboxylase gene may be derived from an *S. cerevisiae* ACC1 gene encoding the amino acid sequence set forth in SEQ ID NO: 74. In other embodiments, an acetyl-CoA carboxylase gene may be derived from a bacterial source. For example, an acetyl-CoA carboxylase gene may be derived from an *E. coli* accA, accB, accC, or accD gene encoding the amino acid sequence set forth in SEQ ID NOs: 75-78, respectively, or a *C. aurantiacus* accA, accB, accC, or accD gene encoding the amino acid sequence set forth in SEQ ID NOs: 79-82, respectively.

An "alanine dehydrogenase gene" as used herein refers to any gene that encodes a polypeptide with alanine dehydrogenase activity, meaning the ability to catalyze the NAD-dependent reductive amination of pyruvate to alanine. Enzymes having alanine dehydrogenase activity are classified as EC 1.4.1.1. In certain embodiments, an alanine dehydrogenase gene may be derived from a bacterial source. For example, an alanine dehydrogenase gene may be derived from a *B. subtilis* alanine dehydrogenase gene encoding the amino acid sequence set forth in SEQ ID NO: 83.

A "pyruvate/alanine aminotransferase gene" as used herein refers to any gene that encodes a polypeptide with pyruvate/alanine aminotransferase activity, meaning the ability to catalyze the conversion of pyruvate and L-glutamate to alanine and 2-oxoglutarate. In certain embodiments, a pyruvate/alanine aminotransferase gene is derived from a yeast source. For example, a pyruvate/alanine aminotransferase gene may be derived from an *S. pombe* pyruvate/alanine aminotransferase gene encoding the amino acid sequence set forth in SEQ ID NO: 84 or an *S. cerevisiae* ALT2 gene encoding the amino acid sequence set forth in SEQ ID NO: 85.

An "alanine 2,3 aminomutase gene" or "AAM gene" as used herein refers to a gene that encodes a polypeptide with alanine 2,3 aminomutase activity, meaning the ability to catalyze the conversion of alanine to β-alanine. Alanine 2,3 aminomutase activity is not known to occur naturally. Therefore, an alanine 2,3 aminomutase gene can be derived by incorporating one or more mutations into a native source gene that encodes a polypeptide with similar activity such as lysine 2,3 aminomutase activity (see, e.g., U.S. Pat. No. 7,309,597). In certain embodiments, the native source gene may be a *B. subtilis* lysine 2,3 aminomutase gene encoding the amino acid sequence set forth in SEQ ID NO: 86, a *P. gingivalis* lysine 2,3 aminomutase gene encoding the amino acid sequence set forth in SEQ ID NO: 87, or a *F. nucleatum* (ATCC-10953) lysine 2,3 aminomutase gene encoding the amino acid sequence set forth in SEQ ID NO: 88.

A "CoA transferase gene" as used herein refers to any gene that encodes a polypeptide with CoA transferase activity, which in one example includes the ability to catalyze the conversion of β-alanine to β-alanyl-CoA and/or the conversion of lactate to lactyl-CoA. In certain embodiments, a CoA transferase gene may be derived from a yeast source. In other embodiments, a CoA transferase gene may be derived from a bacterial source. For example, a CoA transferase gene may be derived from an *M. elsdenii* CoA transferase gene encoding the amino acid sequence set forth in SEQ ID NO: 89.

A "CoA synthetase gene" as used herein refers to any gene that encodes a polypeptide with CoA synthetase activity. In one example this includes the ability to catalyze the conversion of β-alanine to β-alanyl-CoA. In another example, this includes the ability to catalyze the conversion of lactate to lactyl-CoA. In certain embodiments, a CoA synthetase gene may be derived from a yeast source. For example, a CoA synthetase gene may be derived from an *S. cerevisiae* CoA synthetase gene. In other embodiments, a CoA synthetase gene may be derived from a bacterial source. For example, a CoA synthetase gene may be derived from an *E. coli* CoA synthetase, *R. sphaeroides*, or *S. enterica* CoA synthetase gene.

A "β-alanyl-CoA ammonia lyase gene" as used herein refers to any gene that encodes a polypeptide with β-alanyl-CoA ammonia lyase activity, meaning the ability to catalyze the conversion of β-alanyl-CoA to acrylyl-CoA. In certain embodiments, a β-alanyl-CoA ammonia lyase gene may be derived from a bacterial source, such as a *C. propionicum* β-alanyl-CoA ammonia lyase gene encoding the amino acid sequence set forth in SEQ ID NO: 90.

A "3-HP-CoA dehydratase gene" or "acrylyl-CoA hydratase gene" as used herein refers to any gene that encodes a polypeptide with 3-HP-CoA dehydratase gene activity, meaning the ability to catalyze the conversion of acrylyl-CoA to 3-HP-CoA. Enzymes having 3-HP-CoA dehydratase activity are classified as EC 4.2.1.116. In certain embodiments, a 3-HP-CoA dehydratase gene may be derived from a yeast or fungal source, such as a *P. sojae* 3-HP-CoA dehydratase gene encoding the amino acid sequence set forth in SEQ ID NO: 91. In other embodiments, a 3-HP-CoA dehydratase gene may be derived from a bacterial source. For example, a 3-HP-CoA dehydratase gene may be derived from a *C. aurantiacus* 3-HP-CoA dehydratase gene encoding the amino acid sequence set forth in SEQ ID NO: 92, an *R. rubrum* 3-HP-CoA dehydratase gene encoding the amino acid sequence set forth in SEQ ID NO: 93, or an *R. capsulates* 3-HP-CoA dehydratase gene encoding the amino acid sequence set forth in SEQ ID NO: 94. In still other embodiments, a 3-HP-CoA dehydratase gene may be derived from a mammalian source. For example, a 3-HP-CoA dehydratase gene may be derived from a *H. sapiens* 3-HP-CoA dehydratase gene encoding the amino acid sequence set forth in SEQ ID NO: 95.

A "3-HP-CoA hydrolase gene" as used herein refers to any gene that encodes a polypeptide with 3-HP-CoA hydrolase activity, meaning the ability to catalyze the conversion of 3-HP-CoA to 3-HP. In certain embodiments, a 3-HP-CoA gene may be derived from a yeast or fungal source. In other embodiments, a 3-HP-CoA gene may be derived from a bacterial or mammalian source.

A "3-hydroxyisobutyryl-CoA hydrolase gene" as used herein refers to any gene that encodes a polypeptide with 3-hydroxyisobutyryl-CoA hydrolase activity, which in one example includes the ability to catalyze the conversion of 3-HP-CoA to 3-HP. In certain embodiments, a 3-hydroxyisobutyryl-CoA hydrolase gene may be derived from a bacterial source, such as a *P. fluorescens* 3-hydroxyisobutyryl-CoA hydrolase gene encoding the amino acid sequence set forth in SEQ ID NO: 96 or a *B. cereus* 3-hydroxyisobutyryl-CoA hydrolase gene encoding the amino acid sequence set forth in SEQ ID NO: 97. In other embodiments, a 3-hydroxyisobutyryl-CoA hydrolase gene may be derived from a mammalian source, such as a *H. sapiens* 3-hydroxyisobutyryl-CoA hydrolase gene encoding the amino acid sequence set forth in SEQ ID NO: 98.

A "lactate dehydrogenase gene" or "LDH gene" as used herein refers to any gene that encodes a polypeptide with lactate dehydrogenase activity, meaning the ability to catalyze the conversion of pyruvate to lactate. In certain embodiments, an LDH gene may be derived from a fungal, bacterial, or mammalian source.

A "lactyl-CoA dehydratase gene" as used herein refers to any gene that encodes a polypeptide with lactyl-CoA dehydratase activity, meaning the ability to catalyze the conversion of lactyl-CoA to acrylyl-CoA. In certain embodiments, a lactyl-CoA dehydratase gene may be derived from a bacterial source. For example, a lactyl-CoA dehydratase gene may be derived from an *M. elsdenii* lactyl-CoA dehydratase E1, Ella, or Ellb subunit gene encoding the amino acid sequence set forth in SEQ ID NOs: 99-101.

An "aldehyde dehydrogenase gene" as used herein refers to any gene that encodes a polypeptide with aldehyde dehydrogenase activity, which in one example includes the ability to catalyze the conversion of 3-HPA to 3-HP and vice versa. In certain embodiments, an aldehyde dehydrogenase gene may be derived from a yeast source, such as an *S. cerevisiae* aldehyde dehydrogenase gene encoding the amino acid sequence set forth in SEQ ID NO: 102 or an *I. orientalis* aldehyde dehydrogenase gene encoding the amino acid sequence set forth in SEQ ID NOs: 122, 124, or 126. In other embodiments, an aldehyde dehydrogenase may be derived from a bacterial source, such as an *E. coli* aldH gene encoding the amino acid sequence set forth in SEQ ID NO: 103 or a *K. pneumoniae* aldehyde dehydrogenase gene encoding the amino acid sequence set forth in SEQ ID NO: 104.

A "glycerol dehydratase gene" as used herein refers to any gene that encodes a polypeptide with glycerol dehydratase activity, meaning the ability to catalyze the conversion of glycerol to 3-HPA. In certain embodiments, a glycerol dehydratase gene may be derived from a bacterial source, such as a *K. pneumonia* or *C. freundii* glycerol dehydratase gene.

The enzymes of the selected active 3-HP pathway, and activities thereof, can be detected using methods known in the art or as described herein. These detection methods may include use of specific antibodies, formation of an enzyme product, or disappearance of an enzyme substrate. See, for example, Sambrook et al., *Molecular Cloning: A Laboratory Manual*, Third Ed., Cold Spring Harbor Laboratory, New York (2001); Ausubel et al., *Current Protocols in Molecular Biology*, John Wiley and Sons, Baltimore, Md. (1999); and Hanai et al., *Appl. Environ. Microbiol.* 73:7814-7818 (2007)).

The recombinant cells described herein can further contain lipase or esterase activity, for example due to expression of a heterologous polynucleotide encoding a lipase or esterase (EC 3.1.1.-). Such cells can be used to produce an ester of 3-HP, such as methyl 3-hydroxypropionate, ethyl 3-hydroxypropionate, propyl 3-hydroxypropionate, butyl 3-hydroxypropionate, or 2-ethylhexyl 3-hydroxypropionate. The cells can further contain esterase activity, for example due to expression of a heterologous polynucleotide encoding an esterase. Such cells can be used to produce polymerized 3-HP. The cells can further contain alcohol dehydrogenase activity (EC 1.1.1.1), aldehyde dehydrogenase activity (EC 1.2.1.-), or both, for example due to expression of a heterologous polynucleotide encoding an alcohol dehydrogenase, aldehyde dehydrogenase, or both. Such cells can be used to produce 1,3-propanediol.

The recombinant cells may also comprise one or more (e.g., two, several) gene disruptions, e.g., to divert sugar metabolism from undesired products to 3-HP. In some aspects, the recombinant host cells produce a greater amount of 3-HP compared to the cell without the one or more disruptions when cultivated under identical conditions. In some aspects, one or more of the disrupted endogenous genes are inactivated.

In certain embodiments, the recombinant cells provided herein comprise a disruption of one or more endogenous genes encoding an enzyme involved in ethanol fermentation, including for example pyruvate decarboxylase (PDC, converts pyruvate to acetaldehyde) and/or alcohol dehydrogenase (ADH, converts acetaldehyde to ethanol) genes. These modifications decrease the ability of the cell to produce ethanol, thereby maximizing 3-HP production. However, in certain embodiments the recombinant cells provided herein may be engineered to co-produce 3-HP and ethanol. In those embodiments, endogenous genes encoding an enzyme involved in ethanol fermentation are preferably not disrupted, and in certain embodiments the cells may comprise one or more heterologous genes that increase ethanol production.

In some embodiments, the recombinant cells comprise a disruption to an endogenous gene encoding a PDC having at least 75%, e.g., at least 80%, at least 85%, at least 90%, at least 95%, at least 96%, at least 97%, at least 98%, at least 99%, or 100% sequence identity to SEQ ID NO: 154. In some embodiments, the endogenous gene encodes a PDC having an amino acid sequence comprising or consisting of SEQ ID NO: 154. In some embodiments, the coding sequence of the endogenous gene encoding the PDC has at least 75%, e.g., at least 80%, at least 85%, at least 90%, at least 95%, at least 96%, at least 97%, at least 98%, at least 99%, or 100% sequence identity to SEQ ID NO: 153. In some embodiments, the coding sequence of the endogenous gene encoding the PDC comprises or consists of SEQ ID NO: 153. In some embodiments, the endogenous gene encoding the PDC is inactivated.

In certain embodiments, the recombinant cells provided herein comprise a disruption of one or more endogenous genes encoding enzymes involved in producing alternate fermentative products such as glycerol or other byproducts such as acetate or diols. For example, the cells provided herein may comprise a disruption of one or more of glycerol 3-phosphate dehydrogenase (GPD, catalyzes reaction of dihydroxyacetone phosphate to glycerol 3-phosphate), glycerol 3-phosphatase (GPP, catalyzes conversion of glycerol-3 phosphate to glycerol), glycerol kinase (catalyzes conversion of glycerol 3-phosphate to glycerol), dihydroxyacetone kinase (catalyzes conversion of dihydroxyacetone phosphate to dihydroxyacetone), glycerol dehydrogenase (catalyzes conversion of dihydroxyacetone to glycerol), aldehyde dehydrogenase (ALD, e.g., converts acetaldehyde to acetate or 3-HP to 3-HPA), and butanediol dehydrogenase (catalyzes conversion of butanediol to acetoin and vice versa) genes.

In some embodiments, the recombinant cells comprise a disruption to an endogenous gene encoding a GPD having at least 75%, e.g., at least 80%, at least 85%, at least 90%, at least 95%, at least 96%, at least 97%, at least 98%, at least 99%, or 100% sequence identity to SEQ ID NO: 156. In some embodiments, the endogenous gene encodes a GPD having an amino acid sequence comprising or consisting of SEQ ID NO: 156. In some embodiments, the coding sequence of the endogenous gene encoding the GPD has at least 75%, e.g., at least 80%, at least 85%, at least 90%, at least 95%, at least 96%, at least 97%, at least 98%, at least 99%, or 100% sequence identity to SEQ ID NO: 155. In some embodiments, the coding sequence of the endogenous gene encoding the GPD comprises or consists of SEQ ID NO: 155. In some embodiments, the endogenous gene encoding the GPD is inactivated.

In certain embodiments, the recombinant cells provided herein comprise a disruption of one or more endogenous genes encoding enzymes that catalyze a reverse reaction in a 3-HP pathway, including for example PEP carboxykinase (PCK), enzymes with OAA decarboxylase activity, or CYB2A or CYB2B (catalyzes the conversion of lactate to pyruvate). PCK catalyzes the conversion of PEP to OAA and vice versa, but exhibits a preference for the OAA to PEP reaction. To reduce the conversion of OAA to PEP, one or more copies of a native PCK gene may be disrupted. In certain embodiments, cells in which one or more native PCK genes have been disrupted may express one or more heterologous PCK genes that have been mutated to encode a polypeptide favoring the conversion of PEP to OAA. OAA decarboxylase catalyzes the conversion of OAA to pyruvate. Enzymes with OAA decarboxylase activity have been identified, such as that coded by the Entner-Doudoroff aldolase (eda) gene in E. coli and malic enzyme (MAE) in yeast and fungi. To reduce OAA decarboxylase activity, one or more copies of a native gene encoding an enzyme with OAA decarboxylase activity may be disrupted. In certain embodiments, cells in which one or more native OAA decarboxylation genes have been disrupted may express one or more heterologous OAA decarboxylation genes that have been mutated to encode a polypeptide that catalyzes the conversion of pyruvate to OAA.

In certain embodiments, the recombinant cells provided herein comprise a disruption to one or more genes selected from dse2, scw11, eaf3, sed1, and sam2. (See, e.g., Suzuki et al, *J. Biosci. Bioeng.* 2013, 115, 467-474; and Dato et al., *Microbial Cell Factories,* 2014, 13, 147).

In certain embodiments, the recombinant cells provided herein comprise a disruption of one or more endogenous genes encoding an enzyme involved in an undesirable reaction with a 3-HP pathway product or intermediate. Examples of such genes include those encoding an enzyme that converts 3-HP to an aldehyde of 3-HP, which are known to be toxic to certain cells.

In certain embodiments, the recombinant cells provided herein comprise a disruption of one or more endogenous genes encoding an enzyme that has a neutral effect on a 3-HP pathway, including for example GALE (negative regulator of the GAL system that converts galactose to glucose). Disruption of neutral genes allows for insertion of one or more heterologous genes without affecting native pathways.

Modeling can also be used to design gene disruptions that additionally optimize utilization of the pathway (see, for example, U.S. 2002/0012939, U.S. 2003/0224363, U.S. 2004/0029149, U.S. 2004/0072723, U.S. 2003/0059792, U.S. 2002/0168654, U.S. 2004/0009466, and U.S. Pat. No. 7,127,379). Modeling analysis allows reliable predictions of the effects on cell growth of shifting the metabolism towards more efficient production of 3-HP. One exemplary computational method for identifying and designing metabolic alterations favoring biosynthesis of a desired product is the OptKnock computational framework, Burgard et al., 2003, *Biotechnol. Bioeng.* 84: 647-657.

Exemplary methods for disrupting genes are described in detail supra.

Methods of Producing 3-HP and Related Compounds

The host cells described herein comprising an active 3-HP pathway may be used for the production of 3-HP. In one aspect is a method of producing 3-HP, comprising: (a) cultivating a recombinant host cell comprising an active 3-HP pathway and a disruption to an endogenous gene encoding a pyruvate reductase described herein (e.g., the pyruvate reductase of SEQ ID NO: 205) in a fermentable medium under suitable conditions to produce the 3-HP; and (b) recovering the 3-HP.

The recombinant cells comprising an active 3-HP pathway may be cultivated in a nutrient medium suitable for 3-HP production using methods well known in the art. For example, the cells may be cultivated by shake flask cultivation, and small-scale or large-scale fermentation (including continuous, batch, fed-batch, or solid state fermentations) in laboratory or industrial fermentors performed in a suitable fermentation medium and under conditions allowing 3-HP production.

The recombinant cells may produce 3-HP in a fermentable medium comprising any one or more (e.g., two, several) sugars, such as glucose, fructose, sucrose, cellobiose, xylose, xylulose, arabinose, mannose, galactose, and/or soluble oligosaccharides. The carbon source may be a twelve carbon sugar such as sucrose, a hexose sugar such as glucose or fructose, glycan or other polymer of glucose, glucose oligomers such as maltose, maltotriose and isomaltotriose, panose, and fructose oligomers. If the cell is modified to impart an ability to ferment pentose sugars, the fermentation medium may include a pentose sugar such as xylose, xylan or other oligomer of xylose, and/or arabinose. Such pentose sugars are suitably hydrolysates of a hemicellulose-containing biomass. In some embodiments, the cell is unable to ferment pentose sugars and/or the fermentable medium comprises less than 1% pentose sugars. In some instances, the fermentable medium is derived from a natural source, such as sugar cane, starch, or cellulose, and may be the result of pretreating the source by enzymatic hydrolysis (saccharification). In some aspects, the fermentable medium comprises sugar cane juice. Suitable media are available from commercial suppliers, may be prepared according to published compositions (e.g., in catalogues of the American Type Culture Collection), or may be prepared from commercially available ingredients.

In addition to the appropriate carbon sources from one or more (e.g., two, several) sugar(s), the fermentable medium may contain other nutrients or stimulators known to those skilled in the art, such as macronutrients (e.g., nitrogen sources) and micronutrients (e.g., vitamins, mineral salts, and metallic cofactors). In some aspects, the carbon source can be preferentially supplied with at least one nitrogen source, such as yeast extract, $N_2$, peptone (e.g., Bacto™ Peptone), or soytone (e.g., Bacto™ Soytone). Non-limiting examples of vitamins include multivitamins, biotin, pantothenate, nicotinic acid, meso-inositol, thiamine, pyridoxine, para-aminobenzoic acid, folic acid, riboflavin, and Vitamins A, B, C, D, and E. Examples of mineral salts and metallic cofactors include, but are not limited to Na, P, K, Mg, S, Ca, Fe, Zn, Mn, Co, and Cu.

In some embodiments, the recombinant cells of the invention can be cultured in a chemically defined medium. In one example, the medium contains around 5 g/L ammonium sulfate, around 3 g/L potassium dihydrogen phosphate, around 0.5 g/L magnesium sulfate, trace elements, and vitamins and around 150 g/L glucose. The pH may be allowed to range freely during cultivation, or may be buffered if necessary to prevent the pH from falling below or rising above predetermined levels. In certain embodiments, the fermentation medium is inoculated with sufficient cells that are the subject of the evaluation to produce an $OD_{600}$ of about 1.0. Unless explicitly noted otherwise, $OD_{600}$ as used herein refers to an optical density measured at a wavelength of 600 nm with a 1 cm pathlength using a model DU600 spectrophotometer (Beckman Coulter).

Specific conditions used for the methods of 3-HP production may be determined by one skilled in the art in light of the teachings herein. In some aspects of the methods, the cells are cultivated for about 12 hours to about 216 hours, such as about 24 hours to about 144 hours, or about 36 hours to about 96 hours. The temperature is typically between about 26° C. to about 60° C., e.g., about 34° C. to about 50° C.

Cultivation may be performed under anaerobic, substantially anaerobic (microaerobic), or aerobic conditions, as appropriate. Briefly, anaerobic refers to an environment devoid of oxygen, substantially anaerobic (microaerobic) refers to an environment in which the concentration of oxygen is less than air, and aerobic refers to an environment wherein the oxygen concentration is approximately equal to or greater than that of the air. Substantially anaerobic conditions include, for example, a culture, batch fermentation or continuous fermentation such that the dissolved oxygen concentration in the medium remains less than 10% of saturation. Substantially anaerobic conditions also includes growing or resting cells in liquid medium or on solid agar inside a sealed chamber maintained with an atmosphere of less than 1% oxygen. The percent of oxygen can be maintained by, for example, sparging the culture with a $N_2/CO_2$ mixture or other suitable non-oxygen gas or gases. In some embodiments, the cultivation is performed under anaerobic conditions or substantially anaerobic conditions.

In one example, the concentration of cells in the fermentation medium is typically in the range of about 1 to 40, e.g., 2 to 20, or 3 to 10 gram dry cells/liter of fermentation medium during the production phase. If desired, oxygen uptake rate (OUR) can be varied throughout fermentation as a process control (see, e.g., WO03/102200). In some embodiments, the recombinant cells provided herein are cultivated under microaerobic conditions characterized by an oxygen uptake rate from 2 to 45 mmol/L/hr, e.g., 2 to 25, 2 to 20, 2 to 15, 2 to 10, 10 to 45, 15 to 40, 20 to 35, or 25 to 35 mmol/L/hr. In certain embodiments, the recombinant cells provided herein may perform especially well when cultivated under microaerobic conditions characterized by an oxygen uptake rate of from 2 to 25 mmol/L/hr. The medium may be buffered during the production phase such that the pH is maintained in a range of about 3.0 to about 7.0, or from about 4.0 to about 6.0. Suitable buffering agents are basic materials that neutralize the acid as it is formed, and include, for example, calcium hydroxide, calcium carbonate, sodium hydroxide, potassium hydroxide, potassium carbonate, sodium carbonate, ammonium carbonate, ammonia, ammonium hydroxide and the like. In general, those buffering agents that have been used in conventional fermentation processes are also suitable here.

In those embodiments where a buffered fermentation is utilized, acidic fermentation products may be neutralized to the corresponding salt as they are formed. In these embodiments, recovery of the acid involves regeneration of the free acid. This may be done by removing the cells and acidulating the fermentation broth with a strong acid such as sulfuric acid. This results in the formation of a salt by-product. For example, where a calcium salt is utilized as the neutralizing agent and sulfuric acid is utilized as the acidulating agent, gypsum is produced as a salt by-product. This by-product is separated from the broth, and the acid is recovered using techniques such as liquid-liquid extraction, distillation, absorption, and others (see, e.g., T. B. Vickroy, Vol. 3, Chapter 38 of *Comprehensive Biotechnology*, (ed. M. Moo-Young), Pergamon, Oxford, 1985; Datta et al., 1995, *FEMS Microbiol. Rev.* 16: 221-231; U.S. Pat. Nos. 4,275,234, 4,771,001, 5,132,456, 5,420,304, 5,510,526, 5,641,406, and 5,831,122, and WO 93/00440.

In other embodiments, the pH of the fermentation medium may be permitted to drop during cultivation from a starting pH that is at or above the pKa of 3-HP, typically 4.5 or higher (such as 5.5, 6.0 or 6.5), to at or below the pKa of the acid fermentation product, e.g., less than 4.5 or 4.0, such as in the range of about 1.5 to about 4.5, in the range of from about 2.0 to about 4.0, or in the range from about 2.0 to about 3.5.

In still other embodiments, fermentation may be carried out to produce a product acid by adjusting the pH of the fermentation broth to at or below the pKa of the product acid prior to or at the start of the fermentation process. The pH may thereafter be maintained at or below the pKa of the product acid throughout the cultivation. In certain embodiments, the pH may be maintained at less than 4.5 or 4.0, such as in a range of about 1.5 to about 4.5, in a range of about 2.0 to about 4.0, or in a range of about 2.0 to about 3.5.

The methods described herein can employ any suitable fermentation operation mode. For example, batch mode fermentation may be used with a close system where culture media and recombinant host cells, set at the beginning of fermentation, have no additional input except for the reagents certain reagents, e.g., for pH control, foam control or others required for process sustenance. The process described herein can also be employed in Fed-batch or continuous mode, as mentioned supra.

The methods described herein may be practiced in several bioreactor configurations, such as stirred tank, bubble column, airlift reactor and others known to those skilled in the art. The methods may be performed in free cell culture or in immobilized cell culture as appropriate. Any material support for immobilized cell culture may be used, such as alginates, fibrous bed, or argyle materials such as chrysotile, montmorillonite KSF and montmorillonite K-10.

In one aspect of the methods, the 3-HP is produced at a titer greater than about 5 g/L, e.g., greater than about 10 g/L, 25 g/L, 50 g/L, 75 g/L, 100 g/L, 125 g/L, 150 g/L, 160 g/L, 170 g/L, 180 g/L, 190 g/L, 200 g/L, 210 g/L, 225 g/L, 250 g/L, 275 g/L, 300 g/L, 325 g/L, 350 g/L, 400 g/L, or 500 g/L; or between about 10 g/L and about 500 g/L, e.g., between about 50 g/L and about 350 g/L, about 100 g/L and about 300 g/L, about 150 g/L and about 250 g/L, about 175 g/L and about 225 g/L, or about 190 g/L and about 210 g/L. In one embodiment, the 3-HP is produced at a titer greater than about 0.01 gram per gram of carbohydrate, e.g., greater than about 0.02, 0.05, 0.75, 0.1, 0.2, 0.3, 0.4, 0.5, 0.6, 0.7, 0.8, 0.9, or 1.0 gram per gram of carbohydrate.

In certain embodiments of the methods provided herein, the recombinant cells produce relatively low levels of ethanol. In certain embodiments, ethanol may be produced in a yield of 10% or less, preferably in a yield of 2% or less. In certain of these embodiments, ethanol is not detectably produced. In other embodiments, however, 3-HP and ethanol may be co-produced. In these embodiments, ethanol may be produced at a yield of greater than 10%, greater than 25%, or greater than 50%.

The 3-HP can be optionally recovered from the fermentation medium using any procedure known in the art including, but not limited to, chromatography (e.g., size exclusion chromatography, adsorption chromatography, ion exchange chromatography), electrophoretic procedures, differential solubility, osmosis, distillation, extraction (e.g., liquid-liquid extraction), pervaporation, extractive filtration, membrane filtration, membrane separation, reverse, or ultrafiltration. In one aspect, the 3-HP is separated from other fermented material and purified by conventional methods of distillation. Accordingly, in one aspect, the method further comprises purifying the recovered 3-HP by distillation.

The recombinant 3-HP may also be purified by the chemical conversion of impurities (contaminants) to products more easily removed from 3-HP by the procedures described above (e.g., chromatography, electrophoretic procedures, differential solubility, distillation, or extraction) and/or by direct chemical conversion of impurities to 3-HP. For example, in one aspect, the method further comprises purifying recovered 3-HP by converting β-alanine contaminant to 3-HP, using chemical techniques known in the art.

In some aspects of the methods, the recombinant 3-HP preparation before and/or after being optionally purified is substantially pure. With respect to the methods of producing 3-HP, "substantially pure" intends a recovered preparation that contains no more than 15% impurity, wherein impurity intends compounds other than 3-HP. In one variation, a substantially pure preparation is provided wherein the preparation contains no more than 25% impurity, or no more than 20% impurity, or no more than 10% impurity, or no more than 5% impurity, or no more than 3% impurity, or no more than 1% impurity, or no more than 0.5% impurity.

3-HP produced using the methods disclosed herein can be converted into other organic compounds (e.g., as described in U.S. Pat. No. 8,030,045 and WO 03/082795, the content of which is incorporated herein by reference). For example, 3-HP can be hydrogenated to form 1,3 propanediol, a valuable polyester monomer. Propanediol also can be created from 3-HP using polypeptides having oxidoreductase activity in vitro or in vivo (e.g., using one or more additional enzymatic activities as described supra). Hydrogenating an organic acid such as 3-HP can be performed using any method such as those used to hydrogenate succinic acid and/or lactic acid. For example, 3-HP can be hydrogenated using a metal catalyst. Accordingly, in one aspect is a method of producing 1,3-propanediol comprising: (a) cultivating a recombinant cell described herein (e.g., a recombinant host cell comprising an active 3-HP pathway), wherein the recombinant cell further comprises oxidoreductase activity in a medium under suitable conditions to produce 1,3-propanediol; and (b) recovering the 1,3-propanediol. In another aspect is a method of producing 1,3-propanediol, comprising: (a) cultivating a recombinant cell described herein (e.g., a recombinant host cell comprising an active 3-HP pathway) in a medium under suitable conditions to produce 3-HP; (b) recovering the 3-HP; (c) hydrogenating the 3-HP under suitable conditions to produce 1,3-propanediol; and (d) recovering the 1,3-propanediol.

3-HP may also be converted to an ester of 3-HP, such as methyl 3-hydroxypropionate, ethyl 3-hydroxypropionate, propyl 3-hydroxypropionate, butyl 3-hydroxypropionate, or 2-ethylhexyl 3-hydroxypropionate. In one aspect is a method of producing a 3-HP ester comprising: (a) cultivating a recombinant cell described herein (e.g., a recombinant host cell comprising an active 3-HP pathway), wherein the recombinant cell further comprises lipase or esterase activity in a medium under suitable conditions to produce a 3-HP ester; and (b) recovering the 3-HP ester. In another aspect is a method of producing a 3-HP ester, comprising: (a) cultivating a recombinant cell described herein (e.g., a recombinant host cell comprising an active 3-HP pathway) in a medium under suitable conditions to produce 3-HP; (b) recovering the 3-HP; (c) esterifying the 3-HP under suitable conditions to produce a 3-HP ester; and (d) recovering the 3-HP ester. The recombinant host cells described herein may also be used to produce polymerized 3-HP in vitro or in vivo using techniques known in the art (e.g., Zhou et al *Metab. Eng.* 2011, 13(6), 777-785; and U.S. Pat. No. 8,030,045; the contents of which are hereby incorporated by reference).

The 3-HP produced by any of the methods described herein may be converted to acrylic acid. Acrylic acid can be produced by the chemical dehydration of 3-HP using techniques known in the art, e.g., heating in the presence of a catalyst (e.g., a solid oxide dehydration catalyst such as titania or alumina).

In one aspect is a method of producing acrylic acid or a salt thereof, comprising: (a) cultivating a recombinant cell described herein (e.g., a recombinant host cell comprising an active 3-HP pathway) in a medium under suitable conditions to produce 3-HP; (b) recovering the 3-HP; (c) dehydrating the 3-HP under suitable conditions to produce acrylic acid or a salt thereof; and (d) recovering the acrylic acid or salt thereof.

Suitable assays to test for the production of 3-HP, lactate, and derivatives thereof for the methods of production and cells described herein can be performed using methods known in the art. For example, final 3-HP product and intermediates (e.g., pyruvate), as well as other organic compounds, can be analyzed by methods such as HPLC (High Performance Liquid Chromatography), GC-MS (Gas Chromatography Mass Spectroscopy) and LC-MS (Liquid Chromatography-Mass Spectroscopy) or other suitable analytical methods using routine procedures well known in the art. The release of 3-HP in the fermentation broth can also be tested with the culture supernatant. Byproducts and residual sugar in the fermentation medium (e.g., glucose) can be quantified by HPLC using, for example, a refractive index detector for glucose and alcohols, and a UV detector for organic acids (Lin et al., *Biotechnol. Bioeng.* 90:775-779 (2005)), or using other suitable assay and detection methods well known in the art.

The invention may be further described by the following numbered paragraphs:

[1] A recombinant yeast cell, comprising (1) an active 3-HP pathway capable of producing 3-HP and (2) a disruption to an endogenous gene that encodes for a pyruvate reductase, wherein:

(a) the pyruvate reductase has at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to SEQ ID NO: 205;

(b) the coding sequence of the endogenous gene encoding the pyruvate reductase hybridizes under at least low stringency conditions, e.g., medium stringency conditions, medium-high stringency conditions, high stringency conditions, or very high stringency conditions with the full-length complementary strand of SEQ ID NO: 204; or (c) the coding sequence of the endogenous gene encoding the pyruvate reductase has at least 60%, e.g., at least 65%, at least 70%, at least 75%, at least 80%, at least 85%, at least 90%, at least 95%, at least 96%, at least 97%, at least 98%, at least 99%, or 100% sequence identity to SEQ ID NO: 204.

[2] The recombinant cell of paragraph [1], wherein the pyruvate reductase has at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to SEQ ID NO: 205.

[3] The recombinant cell of paragraph [1] or [2], wherein the pyruvate reductase differs by no more than ten amino acids, e.g., by no more than five amino acids, by no more than four amino acids, by no more than three amino acids, by no more than two amino acids, or by one amino acid from SEQ ID NO: 205.

[4] The recombinant cell of paragraph [1], wherein the cell comprises a disruption to an endogenous gene that encodes for a pyruvate reductase comprising or consisting of SEQ ID NO: 205.

[5] The recombinant cell of any one of paragraphs [1]-[4], wherein the coding sequence of the endogenous gene encoding the pyruvate reductase has at least 60%, e.g., at least 65%, at least 70%, at least 75%, at least 80%, at least 85%, at least 90%, at least 95%, at least 96%, at least 97%, at least 98%, at least 99%, or 100% sequence identity to SEQ ID NO: 204.

[6] The recombinant cell of paragraph [1], wherein the coding sequence of the endogenous gene encoding the pyruvate reductase comprises or consists of SEQ ID NO: 204.

[7] The recombinant cell of any one of paragraphs [1]-[6], wherein the coding sequence of the endogenous gene encoding the pyruvate reductase hybridizes under at least low stringency conditions, e.g., medium stringency conditions, medium-high stringency conditions, high stringency conditions, or very high stringency conditions with the full-length complementary strand of SEQ ID NO: 204.

[8] The recombinant cell of any one of paragraphs [1]-[7], wherein the disruption occurs in the coding sequence of the endogenous gene encoding the pyruvate reductase.

[9] The recombinant cell of any one of paragraphs [1]-[8], wherein the disruption occurs in a control sequence of the endogenous gene encoding the pyruvate reductase.

[10] The recombinant cell of any one of paragraphs [1]-[9], wherein cell produces less D-lactate (e.g., at least 25% less, 50% less, at least 60% less, at least 70% less, at least 80% less, at least 90% less, or 100% less) compared to the parent strain that lacks disruption of the endogenous gene encoding for the pyruvate reductase, when cultivated under identical conditions.

[11] The recombinant cell of any one of paragraphs [1]-[10], wherein the cell produces less pyruvate reductase (e.g., at least 25% less, at least 50% less, at least 60% less, at least 70% less, at least 80% less, at least 90% less, or 100% less) compared to the parent strain that lacks disruption of the endogenous gene encoding for the pyruvate reductase, when cultivated under identical conditions.

[12] The recombinant cell of any one of paragraph [1]-[11], wherein the endogenous gene encoding the pyruvate reductase is inactivated.

[13] The recombinant cell of any one of paragraphs [1]-[12], wherein the cell comprises one or more (e.g., two, several) heterologous polynucleotides selected from:

a heterologous polynucleotide encoding a pyruvate dehydrogenase (PDH);

a heterologous polynucleotide encoding an acetyl-CoA carboxylase (ACC);

a heterologous polynucleotide encoding a malonyl-CoA reductase; and a heterologous polynucleotide encoding a 3-HP dehydrogenase (3-HPDH).

[14] The recombinant cell of any one of paragraphs [1]-[12], wherein the cell comprises one or more (e.g., two, several) heterologous polynucleotides selected from:

a heterologous polynucleotide encoding a PEP carboxylase (PPC);

a heterologous polynucleotide encoding a pyruvate carboxylase (PYC);

a heterologous polynucleotide encoding an aspartate aminotransferase (AAT);

a heterologous polynucleotide encoding an aspartate 1-decarboxylase (ADC);

a heterologous polynucleotide encoding a β-alanine aminotransferase (BAAT) or aminobutyrate aminotransferase (gabT); and a heterologous polynucleotide encoding a 3-HP dehydrogenase (3-HPDH).

[15] The recombinant cell of any one of paragraphs [1]-[14], wherein the cell is Crabtree-negative or Crabtree-positive.

[16] The recombinant cell of any one of paragraphs [1]-[15], wherein the cell belongs to a genus selected from *Issatchenkia, Candida, Kluyveromyces, Pichia, Schizosaccharomyces, Torulaspora, Zygosaccharomyces*, and *Saccharomyces*.

[17] The recombinant cell of paragraph [16], wherein the cell is selected from *I. orientalis, C. lambica*, and *S. bulderi*.

[18] The recombinant cell of any one of paragraph [1]-[17], wherein the cell is a CB1 yeast cell.

[19] The recombinant cell of any one of paragraphs [1]-[18], wherein the yeast cell is unable to ferment pentose sugars.

[20] The recombinant cell of any one of paragraphs [1]-[19], wherein said cell further comprises a disruption to one or more endogenous dse2, scw11, eaf3, sed1, or sam2 genes, and/or one or more endogenous genes encoding a PDC, ADH, GALE, CYB2A, CYB2B, GPD, GPP, ALD, or PCK.

[21] The recombinant cell of any one of paragraphs [1]-[20], wherein said cell further comprises a disruption to an endogenous gene encoding a PDC.

[22] The recombinant cell of any one of paragraphs [1]-[21], wherein said cell further comprises a disruption to an endogenous gene encoding a GPD.

[23] A composition comprising the recombinant cell of any one of paragraphs [1]-[22].

[24] The composition of paragraph [23], wherein the composition comprises a fermentable medium.

[25] The composition of paragraph [24], wherein the fermentable medium comprises sucrose, glucose, and/or fructose.

[26] The composition of any one of paragraph [24] or [25], wherein the fermentable medium comprises less than 1% pentose sugars.

[27] The composition of any one of paragraphs [23]-[26], further comprising 3-HP.

[28] The composition of paragraph [26], wherein the 3-HP is at a titer greater than about 1 g/L, e.g., greater than about 2 g/L, 5 g/L, 10 g/L, 15 g/L, 20 g/L, 25 g/L, 30 g/L, 35 g/L, 40 g/L, 45 g/L, 50 g/L, 55 g/L, 60 g/L, 65 g/L, 70 g/L, 75 g/L, 80 g/L, 85 g/L, 90 g/L, 95 g/L, 100 g/L, 125 g/L, 150 g/L, 200 g/L, or 250 g/L.

[29] The composition of any one of paragraphs [23]-[28], wherein the medium is at a pH of less than 6.5, e.g., in the range of about 1.5 to about 4.5, about 2.0 to about 4.0, or about 2.0 to about 3.5.

[30] A method of producing 3-HP, comprising:
(a) cultivating the recombinant yeast cell of any one of paragraphs [1]-[22] in a fermentable medium under suitable conditions to produce 3-HP; and
(b) recovering the 3-HP.

[31] The method of paragraph [30], wherein the fermentable medium comprises sucrose, glucose, and/or fructose.

[32] The method of paragraph [30] or [31], wherein the fermentable medium comprises less than 1% pentose sugars.

[33] The method of any one of paragraphs [30]-[32], wherein the produced 3-HP is at a titer greater than about 1 g/L, e.g., greater than about 2 g/L, 5 g/L, 10 g/L, 15 g/L, 20 g/L, 25 g/L, 30 g/L, 35 g/L, 40 g/L, 45 g/L, 50 g/L, 55 g/L, 60 g/L, 65 g/L, 70 g/L, 75 g/L, 80 g/L, 85 g/L, 90 g/L, 95 g/L, 100 g/L, 125 g/L, 150 g/L, 200 g/L, or 250 g/L.

[34] The method of any one of paragraphs [30]-[33], wherein the resulting 3-HP is substantially pure.

[35] The method of any one of paragraphs [30]-[34], wherein the final pH at the end of fermentation is less than 6.5, e.g., in the range of about 1.5 to about 4.5, about 2.0 to about 4.0, or about 2.0 to about 3.5.

[36] A method of producing acrylic acid or a salt thereof, comprising:
(a) cultivating the recombinant cell of any one of paragraphs [1]-[22] in a fermentable medium under suitable conditions to produce 3-HP;
(b) recovering the 3-HP;
(c) dehydrating the 3-HP under suitable conditions to produce acrylic acid or a salt thereof; and
(d) recovering the acrylic acid or salt thereof.

[37] A method of producing a 3-HP ester, comprising:
(a) cultivating the recombinant cell of any one of paragraphs [1]-[22] in a fermentable medium under suitable conditions to produce 3-HP;
(b) recovering the 3-HP;
(c) esterifying the 3-HP under suitable conditions to produce a 3-HP ester; and
(d) recovering the 3-HP ester

[38] A method of producing 1,3-propanediol, comprising:
(a) cultivating the recombinant cell of any one of paragraphs [1]-[22] in a fermentable medium under suitable conditions to produce 3-HP;
(b) recovering the 3-HP;
(c) hydrogenating the 3-HP under suitable conditions to produce 1,3-propanediol; and
(d) recovering the 1,3-propanediol.

[39] The method of any one of paragraphs [30]-[38] wherein the recombinant cell is a CNB1 cell cultivated in a fermentable medium comprising less than 1% pentose sugars.

[40] A method for obtaining a recombinant host cell of any one of paragraphs [1]-[22], comprising:
(a) cultivating a parent strain;
(b)(i) transforming the parent strain with one or more 3-HP pathway gene(s) to provide an active 3-HP pathway in the parent strain of (a);
(b)(ii) disrupting an endogenous gene encoding a pyruvate reductase in the parent strain of (a); and
(c) isolating the mutant strain resulting from (b)(i) and (b)(ii).

[41] The method of paragraph [40], wherein step (b)(i) occurs prior to step (b)(ii).

[42] The method of paragraph [40], wherein step (b)(ii) occurs prior to step (b)(i).

The following examples are provided by way of illustration and are not intended to be limiting of the invention.

EXAMPLES

Chemicals used as buffers and substrates were commercial products of at least reagent grade.

Media and Solutions

LiOAc/TE solution was composed of 8 parts sterile water, 1 part 1 M LiOAc, and 1 part 10×TE.

2× Noble agar plate medium was composed of 10 g of Difco Agar Noble (Becton, Dickinson and Company) and 250 ml of deionized water, and then sterilized by autoclaving.

PEG/LiOAc/TE Solution was composed of 8 parts 50% PEG3350, 1 part 1 M LiOAc, and 1 part 10× TE.

50% PEG3350 was prepared by adding 100 g of PEG3350 to 150 mL of water and heating and stirring until dissolved. The volume was then brought up to 200 mL with water and then sterilized by autoclaving.

2×SD ura-medium was composed of 6.66 g of yeast nitrogen base without amino acids, 1.54 g of ura-DO supplement (Clontech Laboratories, Inc.), 20 g of dextrose, and deionized water to 1 liter. The resulting solution was filter sterilized.

SD ura-plates were prepared by mixing of 250 mL of 2×-Ura selection medium and 2× Noble agar plate medium (cooled to 65° C. after autoclaving) and then pouring the molten medium into Petri dishes and allowing to cool to room temperature.

TAE buffer was composed of 4.84 g of Tris base, 1.14 mL of glacial acetic acid, and 2 mL of 0.5 M EDTA pH 8.0, and deionized water to 1 liter.

TBE buffer was composed of 10.8 g of Tris base, 5.5 g of boric acid, 4 mL of 0.5 M EDTA pH 8.0, and deionized water to 1 liter.

10×TE (200 mL) was composed of 2.42 g of Tris Base and 4 mL of 0.5 M EDTA, pH 8.0. 5 M HCl was used to adjust the pH to 7.5 and the solution was sterilized by autoclaving.

YP+10% glucose medium was composed of 500 mL of YP broth and 100 mL of sterile 50% glucose.

YPD media was composed of 500 mL of YP broth and 100 mL of sterile 50% glucose.

YP broth was composed of 10 g of yeast extract, 20 g of peptone, and deionized water to 1 liter. The solution was sterilized by autoclaving.

YPD plates were composed of 10 g yeast extract, 20 g bacto peptone, and 20 g of Bacto agar, and deionized water to 1 liter. Following autoclave sterilization, 40 ml of sterile 50% glucose was added per liter and plates poured.

2×YT+amp plates were composed of 16 g of tryptone, 10 g of yeast extract, 5 g of NaCl, and 15 g of Bacto agar, and deionized water to 1 liter. Following autoclave sterilization, 100 mg of ampicillin were added per liter and plates poured.

FOA plates were composed of 250 mL 2×FOA liquid media and 250 mL 2×-SD FOA plate media, melted and cooled to 65° C.

2×-SD FOA liquid media was composed of 6.66 g yeast nitrogen base without amino acids, 1.54 g ura-DO supplement (Clontech, Mountain View, Calif., USA), 20 g dextrose, 50 mg uracil, 2 mg uridine, and 2 g 5-FOA (5-fluoroorotic acid, monohydrate; Toronto Research Chemicals, North York, ON, Canada) and water to 1 L. The resulting solution was filtered to sterilize.

2×-SD FOA plate media was composed of 10 g bacto agar and 250 mL water. The resulting solution was autoclaved to sterilize.

TABLE 1

Primers sequences used in the Examples.

| Identifier | SEQ ID NO: | Sequence (5' to 3') |
|---|---|---|
| 612908 | 207 | GATATGGGCG GTAGAGAAGA |
| 612909 | 208 | GCTCCTTCAA AGGCAACACA |
| 1209140 | 209 | GTAAAACGAC GGCCAGTGAG TTCGTTAACG GTAGAGTCTC TCCTTCTGGT TCG |
| 1209141 | 210 | AAAAATAAAC TAGTAAAATA AATTAATTAA CATGCGGCCG CAAGTGTGAG AGAAGGAGAA AGACCG |
| 1209142 | 211 | CTGGAGAATA GATCTTCAAC GCGTTTAAAC TGTGCGGCCG CCTGAAGTG CCATTCCCAT CACATGG |
| 1209143 | 212 | GACCATGATT ACGCCAAGCT CCGCGGTAGC GGGGAAGATA TTTTTTGAAT A |
| 1209724 | 213 | CCACAAGCCA CAATGATGAT AAATGGG |
| 1209725 | 214 | GTTGTAGAGT GTATGCGGCA ATGG |
| 1210137 | 215 | GTTGAACAAC TTGTTGAAGC TCGTCC |
| 1210138 | 216 | TCGGCACGGC CAAGGTGCTC |

Example 1: Identification of Pyruvate Reductase Enzyme

A pyruvate reductase activity assay was used to follow activity of fractionated fermentation broth harvested at 48 hr from a CNB1-derived yeast cell comprising an active 3-HP pathway (See, WO2012/074818).

A cell pellet from 750 mL broth was resuspended in 100 ml PBS containing 1% Protease Inhibitor Cocktail (Roche Diagnostics). Cell suspension was transferred to a 50 ml conical tube with approximately 15 ml volume of Lysing Matrix Y (0.5 mm yttria-stabilized zirconium spheres; MP Biomedicals), and cell lysis was performed using a FastPrep®-24 disruptor (MP Biomedicals) Three 60 second beating cycles were carried out at 6.5 m/s$^2$ with 5 minute on-ice cooling between cycles. The tubes were centrifuged at 8370×g and 4° C. for 15 min and each supernatant transferred to a fresh tube. The supernatant was then centrifuged for an additional 45 min at 28,880×g at 4° C. The soluble protein fraction then was precipitated with 100% ammonium sulfate for 1 hr and the protein centrifuged for 15 minutes at 10,000×g. The pellet was stored at −20° C.

The pellet was thawed and resuspended in FPLC (AKTA purifier, GE Healthcare) start buffer: 20 mM Tris pH 8. Addition of 100 ml buffer was required to solubilize the proteins, and 30 ml was prepped for fractionation. Protein was desalted using Econo-Pac 10DG Desalting columns (Bio Rad). Desalted protein was loaded onto a Q Sepharose HP (GE Healthcare) 50 ml column and protein was eluted with a gradient from 0 to 60% Buffer B (20 mM Tris pH 8, 1 M NaCl) over 10 CV, followed by 100% Buffer B over 2 CV.

Activity assays were run on all fractions, as described in Example 6, and active fractions were identified and pooled for further fractionation. Protein eluted from Q Sepharose HP column at approximately 300 mM NaCl. Protein was buffer exchanged into 20 mM Tris pH 7.5 using gravity columns and loaded onto Source 15Phe 4.6/100 PE column (GE Healthcare). Protein was eluted with a gradient over 20CV to 100% Buffer B (20 mM Tris pH 7.5 1 M Ammonium sulfate), and the protein of interest eluted at approximately 500 mM ammonium sulfate concentration. Fractions were tested for activity as described supra and then concentrated by speed vacuum and desalted (as described supra) to run on SDS-Page Criterion gel 8-16% Tris-HCl (Bio Rad). Four bands were identified and sent for peptide mass fingerprinting ID by MADLI (Bruker Autoflex). Some bands returned homology to known enzymes that were not similar to a pyruvate reductase, and two bands were unknown function. The protein corresponding to g4240 (SEQ ID NO: 205) had the recognition sequence for NADH/NADPH cofactor and was chosen for disruption and further analysis as described below.

Example 2: Procedure for DNA Transformation

DNA transformation into the host genome to generate the recombinant strains described in the following examples was conducted based on the specific procedure below.

Four mL of YP+10% glucose media was added to a 14 mL Falcon tube and the desired strain was inoculated into this media using a sterile loop. The culture was grown with shaking at 250 rpm overnight (~16 hr) at 37° C. 1 mL of the overnight culture was added to a 250 mL baffled flask containing 50 mL of liquid YP+10% glucose media. The flask was grown with shaking at 250 rpm at 37° C. Small aliquots of the culture were withdrawn at approximately hourly intervals and the $OD_{600}$ was measured. The culture was grown until the $OD_{600}$ was 0.6-1.0.

The cells were harvested by centrifugation at 2279×g at room temperature, the pellet was resuspended in 25 mL sterile water, then centrifuged at 2279×g at room temperature. The pellet was resuspended in 1 mL sterile water, and the resuspended cells were transferred to a 1.5 mL tube and then pelleted at 16,100×g. The cells were resuspended in 1 mL LiOAc/TE solution and then pelleted at 16,100×g. The cell pellet was then resuspended in 500 μL LiOAc/TE solution.

The following components were added to a 1.5 mL tube: 100 μL of the above cells, 10 μL freshly boiled then iced salmon sperm DNA (Agilent Technologies, Santa Clara, Calif., USA), and 10 μL of the desired, linearized transforming DNA. A control reaction with water instead of DNA was also prepared. To each transformation reaction, 600 μL of PEG/LiOAc/TE Solution was added, followed by 40 μL DMSO and the reactions were inverted several times to mix. The transformation reactions were incubated in a 42° C. water bath for 5 minutes, and cells were pelleted at 5,400×g for 1 min. Cells were resuspended in water, split in two, and each half of the transformation reaction was plated to a ura selection media plate. Plates were placed at 37° C. Colonies were visible after 18 to 24 hr of growth.

Example 3: Cloning a Left-Hand Disruption Construct for the Pyruvate Reductase Locus In order to create a plasmid that targets homologous recombination of the 5' half of the URA3 selectable marker to the pyruvate reductase locus of the CNB1 yeast (WO2012/074818), the DNA region 5' of pyruvate reductase was PCR amplified with primers 1209140 and 1209141.

Primer 1209140 contains a 5' region homologous to the pMHCT246 destination vector (WO2015/017721), a HpaI site, and homology to the CNB1 pyruvate reductase 5' flanking DNA. Primer 1209141 is a reverse complement primer with a 5' region homologous to the pMHCT246 destination vector, a PacI and NotI site, and homology to the CNB1 pyruvate reductase 5' flanking DNA.

Each PCR reaction (50 μL) contained 10 ng of genomic DNA (preparable, e.g., using a MasterPure™ Yeast DNA Purification Kit from EPICENTRE® Biotechnologies) isolated from strain MBIN500 (WO2012/074818), 1×HF buffer (Thermo Scientific), 100 pmol each of primers 1209140 and 1209141, 200 μM each of dATP, dCTP, dGTP, and dTTP, and one unit of Phusion HS II DNA polymerase (Thermo Scientific). Eight identical reactions were set up and a gradient PCR was performed in an EPPENDORF® MASTERCYCLER® (Eppendorf Scientific) programmed for one cycle at 98° C. for 30 seconds followed by 35 cycles each at 98° C. for 10 seconds, gradient annealing temperature for 30 seconds, and 72° C. for 1 minute, with a final extension at 72° C. for 10 minutes. The annealing temperature gradient was 50, 51.4, 53.8, 57.5, 62, 65.9, 68.5, and 70.0° C., with one tube at each temperature. Following thermocycling, the PCR reaction products were separated by 0.9% agarose gel electrophoresis in TAE buffer with each gradient condition in a separate lane. Visualization of the gel showed that all eight annealing temperature successfully amplified the product, so the 940 bp PCR product was excised from the gel for all lanes and purified together using a NUCLEOSPIN® Extract II Kit (Macherey-Nagel, Bethlehem, Pa., USA) according to the manufacturer's instructions.

To create a destination vector for the 5' flanking DNA, plasmid pMHCT246 (WO2015/017721) was digested with HpaI and PacI and the resulting fragments were separated by 0.9% agarose gel electrophoresis in TAE buffer where the band of approximately 4 kbp was excised from the gel and purified using a NUCLEOSPIN® Extract II Kit according to the manufacturer's instructions.

The pyruvate reductase 5' flanking DNA and pMHCT246 vector fragment were combined using an IN-FUSION™ HD Cloning Kit (Clontech) in a total reaction volume of 10 μL composed of 150 ng pMhCt246 HpaI and PacI vector fragment, 70 ng of the 5' pyruvate reductase flanking DNA PCR product, and 1× In-Fusion HD reaction buffer (Clontech). The reaction was incubated at 37° C. for 15 minutes, 50° C. for 15 minutes, and then placed on ice. 2 μl of the reaction was used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired pyruvate reductase flanking DNA with MfeI and NotI, and the desired insertion for one isolated plasmid with the expected digestion pattern was confirmed by DNA sequencing and designated pMHCT260b.

Plasmid pMHCT260b (FIG. 2) is a pUC19 (Yanisch-Perron, C., Vieira, J. and Messing, J. (1985) Gene, 33, 103-119) based vector with the 5' pyruvate reductase flanking DNA targeting sequence, the URA3 promoter and the 5' fragment of the URA3 ORF.

Example 4: Cloning a Right-Hand Disruption Construct for the Pyruvate Reductase Locus In order to create a plasmid that targets homologous recombination of the 3' half of the URA3 selectable marker to the pyruvate reductase locus of the CNB1 yeast (WO2012/074818), the DNA region 3' of pyruvate reductase was PCR amplified with primers 1209142 and 1209143.

Primer 1209142 contains a 5' region homologous to the pMHCT247 destination vector, a NotI site, and homology to the CNB1 pyruvate reductase 3' flanking DNA. Primer 1209143 is a reverse complement primer with a 5' region homologous to the pMHCT247 destination vector, a SacII site, and homology to the CNB1 pyruvate reductase 3' flanking DNA.

Each PCR reaction (50 μL) contained 10 ng of genomic DNA isolated from strain MBIN500 (WO2012074818), 1× ThermoPol Reaction buffer (New England Biolabs), 100 pmol each of primers 1209142 and 1209143, 200 μM each of dATP, dCTP, dGTP, and dTTP, 2 μL 100 mM MgSO$_4$, and 2 units of Vent$_R$® (exo-) DNA polymerase (New England Biolabs). Eight identical reactions were set up and a gradient PCR was performed in an EPPENDORF® MASTERCYCLER® (Eppendorf Scientific) programmed for one cycle at 94° C. for 2 minutes followed by 34 cycles each at 94° C. for 30 seconds, gradient annealing temperature for 30 seconds, and 72° C. for 1 minute, with a final extension at 72° C. for 10 minutes. The annealing temperature gradient was 50, 51.4, 53.8, 57.5, 62, 65.9, 68.5, and 70.0° C., with one tube at each temperature. Following thermocycling, the PCR reaction products were separated by 0.9% agarose gel electrophoresis in TAE buffer with each gradient condition in a separate lane. Visualization of the gel showed that the six reactions with the lowest annealing temperatures successfully amplified the product, so the approximately 470 bp PCR product was excised from the gel for these six lanes and purified together using a NUCLEOSPIN® Extract II Kit (Macherey-Nagel, Bethlehem, Pa., USA) according to the manufacturer's instructions.

Figure 3:
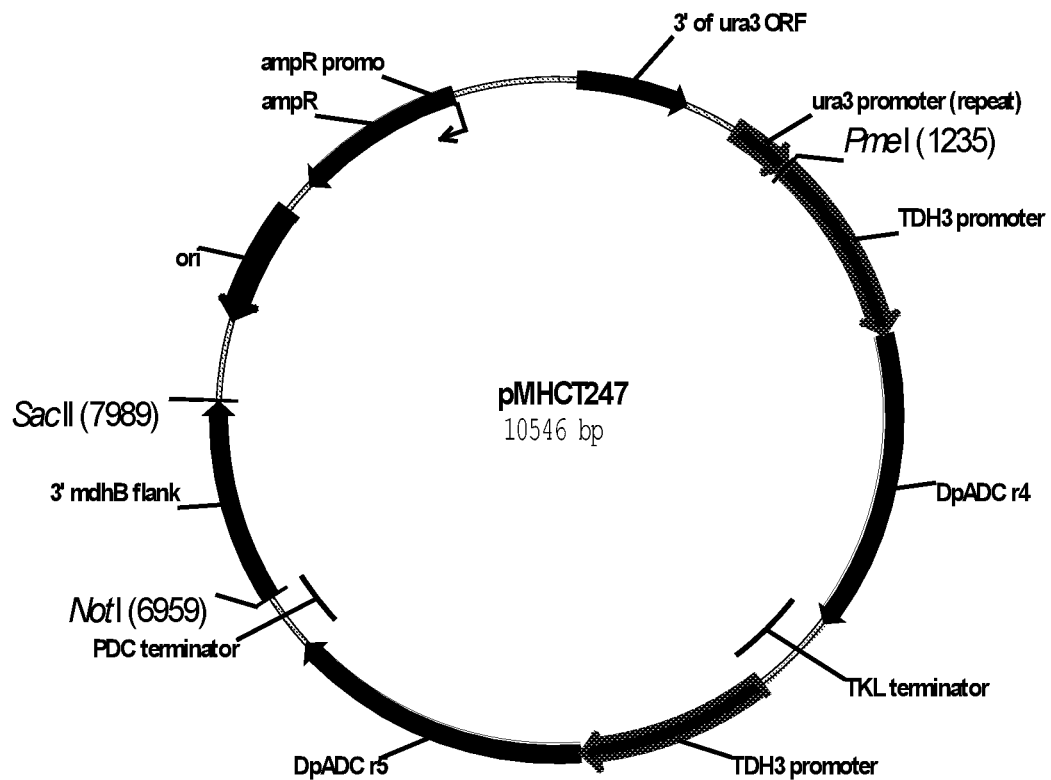
FIG. 3 shows a plasmid map for pMHCT247.

Plasmid pMHCT247 (FIG. 3) is analogous to pMHCT239 (WO2015/017721) except that a DNA fragment with homology to DNA 3' of the malate dehydrogenase (mdhB) locus (SEQ ID NO: 206) was inserted 3' of the PDC terminator to allow targeting to the mdhB locus.

To create a destination vector for the 3' flanking DNA, plasmid pMHCT247 was digested with PmeI and SacII and the resulting fragments were separated by 0.9% agarose gel electrophoresis in TAE buffer where the band of approximately 3.8 kbp was excised from the gel and purified using a NUCLEOSPIN® Extract II Kit according to the manufacturer's instructions.

The pyruvate reductase 3' flanking DNA and pMHCT247 vector fragment were combined using an IN-FUSION™ HD Cloning Kit (Clontech) in a total reaction volume of 10 μL composed of 50 ng pMhCt247 PmeI and SacII vector fragment, 21 ng of the 3' pyruvate reductase flanking DNA PCR product, and 1× In-Fusion HD reaction buffer (Clontech). The reaction was incubated at 37° C. for 15 minutes, 50° C. for 15 minutes, and then placed on ice. Two μl of the reaction was used to transform Stellar™ Competent Cells according to the manufacturer's instructions. The transformation reaction was spread onto 2×YT+amp plates and incubated at 37° C. overnight. Putative transformant colonies were isolated from the selection plates and plasmid DNA was prepared from each one using a BIOROBOT® 9600 and screened for proper insertion of the desired pyruvate reductase flanking DNA with MfeI and NotI, and the desired insertion pattern for one isolated plasmid with the expected digestion pattern was confirmed by DNA sequencing and designated pMHCT261.

Plasmid pMHCT261 (FIG. 4) is a pUC19 (Yanisch-Perron, C., Vieira, J. and Messing, J. (1985) Gene, 33, 103-119) based vector with the 3' fragment of the URA3 ORF, the URA3 terminator, the URA3 promoter, and the 3' pyruvate reductase flanking DNA targeting sequence.

Example 5: Disruption of the Pyruvate Reductase Locus in a Yeast Host Cell

This example describes the construction of a yeast strain with a disruption of the pyruvate reductase gene comprising the coding sequence of SEQ ID NO: 204, which encodes for the pyruvate reductase of SEQ ID NO: 205.

Prior to transformation, approximately 25 μg of pMHCT260b (supra) were digested with HpaI, SadI, and BsaI to release the desired transforming DNA from the pUC19 backbone vector. Likewise, approximately μg of pMHCT261 (supra) were digested with PfoI, SadI, and BsaI to release the desired transforming DNA from the pUC19 backbone vector. For pMHCT260b, an approximately 2.3 kbp band (containing the desired left-side of the disruption cassette) was separated from the vector DNA by 0.9% agarose gel electrophoresis in TAE buffer, excised from the gel, and purified using a NUCLEOSPIN® Extract II Kit according to the manufacturer's instructions. For pMHCT261, an approximately 2.0 kbp band (containing the desired right-side of the disruption cassette) was separated from the vector DNA by 0.9% agarose gel electrophoresis in TAE buffer, excised from the gel, and purified using a NUCLEOSPIN® Extract II Kit according to the manufacturer's instructions. Each DNA was eluted in 20 μl of manufacturer's supplied elution buffer, prewarmed to 65 C. 4 μl of the purified pMHCT260b fragment and 4 μl of the purified pMHCT261 fragment were used to transform strain Ckle 213 (containing an active 3-HP pathway, and derived from the CNB1 yeast strain described in WO2012/074818).

Transformants were selected on SD ura-plates at 30° C. Twenty-four transformants were picked after three days and restreaked for single colonies on SD ura-plates and grown at 37° C. for two days. Then a single colony was picked from each of the streaks generated by each initial transformant and restreaked on SD ura-plates.

Following the round of single colony purification and outgrowth, PCRs were performed to verify the desired targeted integration occurred as described herein. Correct disruption of one allele of the pyruvate reductase locus was verified using primers 1209724 and 612909 as well as primers 612908 and 1209725. Primer 1209724 binds the genome 5' of the 5' pyruvate reductase flanking DNA in pMHCT260b, while primer 612909 binds the URA3 ORF and amplifies in the anti-sense direction. Generation of an approximately 2.0 kbp band by PCR with these primers indicates the occurrence of the desired integration event resulting in the replacement of the pyruvate reductase ORF with the URA3 selectable marker. Primer 612908 binds the URA3 ORF, while primer 1209725 binds the genome 3' of the 3' pyruvate reductase flanking DNA in pMHCT261 and amplifies in the anti-sense direction. Generation of an approximately 1.4 kbp band by PCR with these primers indicates the occurrence of the desired integration event resulting in the replacement of the pyruvate reductase ORF with the URA3 selectable marker.

Template DNA for the PCRs was prepared by resuspending a small amount of yeast in 10 μL of water. Forty μL of Y-lysis buffer (Zymo Research) and 2 μL of Zymolyase (Zymo Research) were then added and the resuspended yeast cells were incubated at 37° C. for 30 minutes. The tubes were then shifted to 4° C. until PCR.

The PCRs (25 μL) were composed of 1 μL of template DNA (as described above) for the strain to be screened, 1× LongAmp® Taq Reaction Buffer (New England Biolabs, Inc.), 0.4 μM of the sense primer, 0.4 μM of the anti-sense primer, 300 μM each of dATP, dCTP, dGTP, and dTTP, and 2.5 units of LongAmp® Taq DNA polymerase (New England Biolabs, Inc.). The PCRs were performed in an EPPENDORF® MASTERCYCLER® programmed for 1 cycle at 94° C. for 4 minutes followed by 32 cycles each at 94° C. for 20 seconds, 60° C. for 20 seconds, and 65° C. for 2 minutes, with a final extension at 65° C. for 10 minutes. Following thermocycling, the PCR products were separated by 0.9% agarose gel electrophoresis in TBE buffer and the sizes of the bands visualized and interpreted as described above. Two independently isolated transformants having the desired bands were designated yMhCt230 and yMhCt231. Strains yMhCt230 and yMhCt231 are heterozygous for deletion of the pyruvate reductase locus.

To obtain ura-derivatives of these strains, yMHCT230 and yMHCT231 were grown overnight in SD ura-media. 100 μl of the overnight culture was added to 4 ml of YPD media and grown at 37° C. for five hours. 125 ul of the culture was plated to an FOA plates. FOA-resistant colonies were streaked for single colonies to YPD plates, then a single colony was picked from each of these streaks and streaked to a YPD plate.

Following FOA selection and single colony isolation, PCR was used to confirm the desired loop-out removal of the URA3 selectable marker as described herein using primers 1209724 and 1209725. Primer 1209724 binds the genome 5' of the 5' pyruvate reductase flanking DNA in pMHCT260b, while primer 1209725 binds the genome 3' of the 3' pyruvate reductase flanking DNA in pMHCT261 and amplifies in the anti-sense direction. Generation of an approximately 2.3 kbp band by PCR with these primers indicates the occurrence of the desired loop-out of the URA3 selectable marker, while an approximately 2.6 kbp band by PCR with these primers indicates the presence of the wild-type pyruvate reductase locus. Generation of an approximately 3.7 kbp band indicates that the URA3 selectable marker was not removed from the disrupted copy of the pyruvate reductase locus.

Template DNA for the PCRs was prepared by resuspending a small amount of yeast in 10 μL of water. Forty μL of Y-lysis buffer (Zymo Research) and 2 μL of Zymolyase (Zymo Research) were then added and the resuspended yeast cells were incubated at 37° C. for 30 minutes. The tubes were then shifted to 4° C. until PCR.

The PCRs (25 μL) were composed of 1 μL of template DNA (as described above) for the strain to be screened, 1× LongAmp® Taq Reaction Buffer (New England Biolabs, Inc.), 0.4 μM of the sense primer, 0.4 μM of the anti-sense primer, 300 μM each of dATP, dCTP, dGTP, and dTTP, and 2.5 units of LongAmp® Taq DNA polymerase (New England Biolabs, Inc.). The PCRs were performed in an EPPENDORF® MASTERCYCLER® programmed for 1 cycle at 94° C. for 4 minutes followed by 32 cycles each at 94° C. for 20 seconds, 60° C. for 20 seconds, and 65° C. for 4 minutes, with a final extension at 65° C. for 10 minutes. Following thermocycling, the PCR products were separated by 0.9% agarose gel electrophoresis in TBE buffer and the sizes of the bands visualized and interpreted as described above. One FOA resistant colony derived from yMHCT230 having the desired doublet of bands of 2.3 and 2.6 kbp (indicating it was heterozygous for the pyruvate reductase deletion after marker loop-out) was designated yMhCt232. Likewise, one FOA resistant colony derived from yMHCT231 having the desired doublet of bands was designated yMhCt233.

To generate strains homozygous for deletion of the pyruvate reductase locus, yMHCT232 and yMHCT233 were each transformed with 4 μl of the purified pMHCT260b fragment and 4 μl of the purified pMHCT261 fragment prepared as described above. Transformants were selected on SD ura-plates at 37° C. Thirty six transformants from each transformed strain were picked after five days and restreaked for single colonies on SD ura-plates and grown at 37° C. for two days. Then a single colony was picked from each of the streaks generated by each initial transformant and restreaked on SD ura-plates.

Following this single colony isolation of transformants, PCR was used to confirm the absence of the pyruvate reductase gene and appropriate integration of the URA3 selectable marker using three primer sets as described herein. A PCR with primer 1210137 (anneals in the pyruvate reductase open reading frame) and primer 1209725 (binds the genome 3' of the 3' pyruvate reductase flanking DNA in pMHCT261 and amplifies in the anti-sense direction) does not generate a band of any size if the pyruvate reductase is deleted but generates a 670 bp band if the pyruvate reductase gene is present. A PCR with primer 1209724 (binds the genome 5' of the 5' pyruvate reductase flanking DNA in pMHCT260b) and primer 1210138 (anneals in the pyruvate reductase open reading frame and amplifies in the anti-sense direction) does not generate a band of any size if the pyruvate reductase is deleted but generates a band of approximately 1.1 kbp if the pyruvate reductase gene is present. A PCR with primers 1209724 (binds the genome 5' of the 5' pyruvate reductase flanking DNA in pMHCT260b) and primer 1209725 (binds the genome 3' of the 3' pyruvate reductase flanking DNA in pMHCT261 and amplifies in the anti-sense direction) generates an approximately 3.7 kbp band if pyruvate reductase is disrupted with the URA3 selectable marker, while an approximately 2.3 kbp band indicates the presence a pyruvate reductase locus containing only the ura3 promoter region following loop-out of the selectable marker cassette.

Template DNA for the PCRs was prepared by resuspending a small amount of yeast in 10 μL of water. Forty μL of Y-lysis buffer (Zymo Research) and 2 μL of Zymolyase (Zymo Research) were then added and the resuspended yeast cells were incubated at 37° C. for 30 minutes. The tubes were then shifted to 4° C. until PCR.

The PCRs (25 μL) were composed of 1 μL of template DNA (as described above) for the strain to be screened, 1× LongAmp® Taq Reaction Buffer (New England Biolabs, Inc.), 0.4 μM of the sense primer, 0.4 μM of the anti-sense primer, 300 μM each of dATP, dCTP, dGTP, and dTTP, and 2.5 units of LongAmp® Taq DNA polymerase (New England Biolabs, Inc.). The PCRs were performed in an EPPENDORF® MASTERCYCLER® programmed for 1 cycle at 94° C. for 4 minutes followed by 32 cycles each at 94° C. for 20 seconds, 60° C. for 20 seconds, and 65° C. for either 1 minute (for the primer 1210137+primer 12097254 PCRs) or 4 minutes (for the primer 1209724+primer 1210138 or for the primer 1209724+primer 1209725 PCRs), with a final extension at 65° C. for 10 minutes. Following thermocycling, the PCR products were separated by 0.9% agarose gel electrophoresis in TBE buffer and the sizes of the bands visualized and interpreted as described above. Two transformants derived from yMHCT232 having the desired bands for disruption of both copies of the pyruvate reductase locus were designated yMhCt234 and yMHCT235. Likewise, two transformants derived from yMHCT233 having the desired bands were designated yMhCt236 and yMHCT237.

Example 6: Pyruvate Reductase Activity for Mutant Strains with Disruption of the Pyruvate Reductase Locus Preparation of Crude Cell-Free Extracts (CFE) for Enzyme Assays:

Crude cell-free extract from mutant strains MhCt235 and MhCt236 (Example 5) and control strain Ckle210 (ura plus parent of Ckle213, predecessor of MhCt235 and MhCt236 derived from the CNB1 yeast strain described in WO2012/074818) were each collected by centrifugation, the supernatants discarded, and the cell pellets washed with an equal volume of phosphate-buffer saline (PBS). Fermentations were assayed at 2 time points (16 and 40 hr) for enzymatic activity. For preparation of crude cell-free extracts (CFE), each cell pellet was resuspended to an equivalent $OD_{600}$ of 25 with PBS containing 1% Protease Inhibitor Cocktail (Roche Diagnostics) and 10 mM potassium phosphate pH 7. Each cell suspension was transferred to a 2.0 mL microcentrifuge tube with 2.4 g of Lysing Matrix Y (0.5 mm yttria-stabilized zirconium spheres; MP Biomedicals), and cell lysis was performed using a FastPrep®-24 disruptor (MP Biomedicals) for 3 rounds at a setting 6.5/50 seconds. Sample tubes were cooled on ice for 3 minutes between each round. After lysis, the samples were centrifuged at maximum speed in a microcentrifuge for 10 minutes at 4° C. The supernatants were transferred to fresh tubes and kept on ice or stored at −20° C. until use. Total protein concentrations in the lysates were determined using a BCA Protein Assay Reagent Kit (Thermo Fisher Scientific Inc.) with bovine serum albumin as the standard, according to the instructions provided by the manufacturer.

Pyruvate Reductase Activity Assay:

NADH dependent pyruvate reductase activity in CFE of the indicated cells supra were determined as follows: A stock reaction mix solution was prepared that, when combined with CFE in the assay reaction mixture, provided the following: 100 mM Tris (pH 8.0); 500 μM NADH; and 5 mM pyruvate. 180 µL of this mixture was added to the wells of a 96-well microtiter plate and 20 µL of an appropriately diluted CFE was added to start the reaction. Oxidation of NADH was monitored at 340 nm using a SpectraMax 340 PC plate reader. Formation of lactate was verified by LC/MS (Agilent 1200 series HPLC with Agilent 6410 Triple Quad LC/MS detector), and the D stereoisomer was confirmed by D and L lactate assay kits (Biovision).

Figure 5:
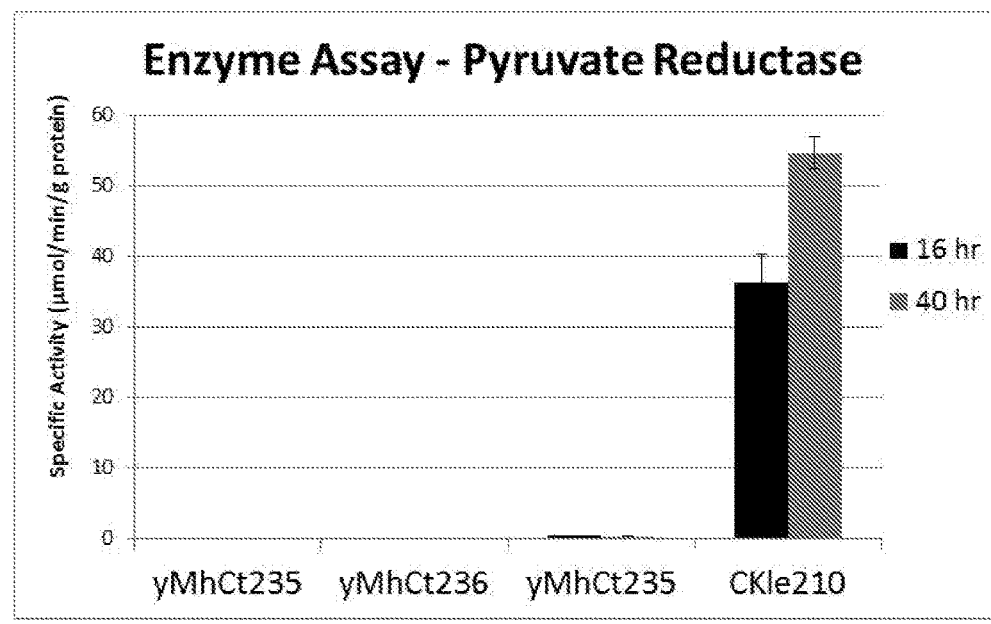
FIG. 5 shows the pyruvate reductase activities for strains MhCt235, MhCt236, and Ckle210 at 16 hr and 24 hr.

The resulting pyruvate reductase activities at 16 hr and 24 hr are shown in FIG. 5 (rate of D-lactate produced in vitro). Mutant strains MhCt235 and MhCt236 (which comprise the disrupted pyruvate reductase) showed no activity in vitro for the reduction of pyruvate.

Example 7: Lactate Production in for Mutant Strains with Disruption of the Pyruvate Reductase Locus Mutant strains MhCt235 and MhCt236 (Example 5) and control strain Ckle210 (ura plus parent of Ckle213, predecessor of MhCt235 and MhCt236 derived from the CNB1 yeast strain described in WO2012/074818) were cultivated using a seed propagation stage, followed by a single stage fermentation in a 3 L bioreactor (Applikon, Foster City, Calif., USA), using a similar method as described in WO 2014/085330.

Figure 6:
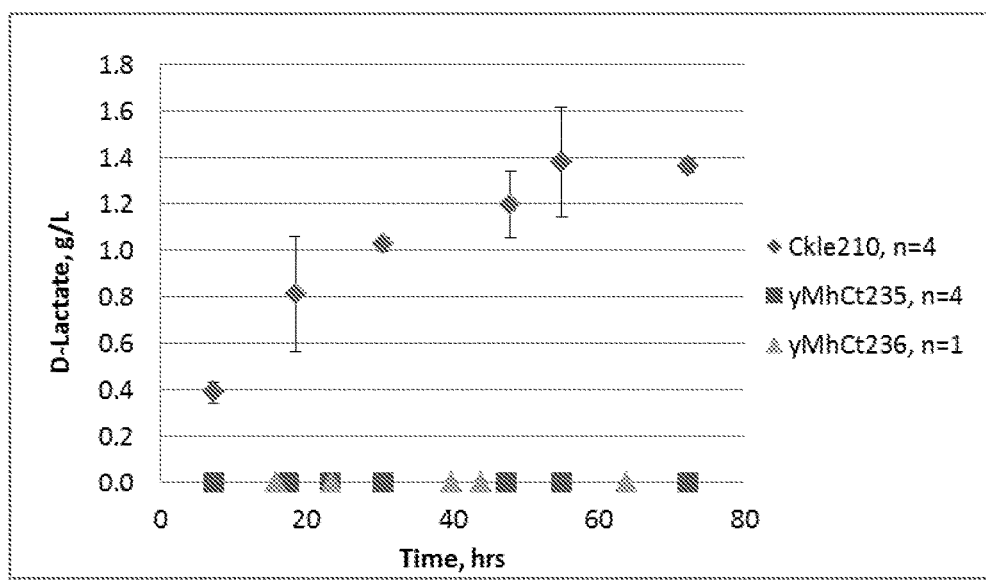
FIG. 6 shows the amount of D-lactate formation for strains MhCt235, MhCt236, and Ckle210 through 80 hr fermentation.

The resulting D-lactate formation from fermentation through 80 hr is shown in FIG. 6. Mutant strains MhCt235 and MhCt236 (which comprise the disrupted pyruvate reductase) showed no detectable D-lactate, while parent strain Ckle210 accumulated up to 1.4 g/L D-lactate (based on an average of four independent fermentations).

Although the foregoing has been described in some detail by way of illustration and example for the purposes of clarity of understanding, it is apparent to those skilled in the art that any equivalent aspect or modification may be practiced. Therefore, the description and examples should not be construed as limiting the scope of the invention.

SEQUENCE LISTING (216 sequences)

SEQ ID NO: 1 - DNA, 3543 bp, Issatchenkia orientalis
atgtcaactgtggaagatcactcctccctacataaattgagaaaggaatctgagattctttccaatgcaaacaaaatcttagtggctaatagaggtgaaattccaattagaattttcaggtcagcccatgaattgtcaatgcatactgtggcgatctattcccatgaagatcggttgtccatgcataggttgaaggccgacgaggcttatgcaatcggtaagactggtcaatattcgccagttcaagcttatctacaaattgacgaaattatcaaaatagcaaaggaacatgatgtttccatgatccatccaggttatggtttcttatctgaaaactccgaattcgcaaagaaggttgaagaatccggtatgatttgggttgggcctcctgctgaagttattgattctgttggtgacaaggtttctgcaagaaatttggcaattaaatgtgacgttcctgttgttcctggtaccgatggtccaattgaagacattgaacaggctaaacagtttgtggaacaatatggttatcctgtcattataaaggctgcatttggtggtggtggtagaggtatgagagttgttagagaaggtgatgatatagttgatgctttccaaagagcgtcatctgaagcaaagtctgcctttggtaatggtacttgttttattgaaagatttttggataagccaaaacatattgaggttcaattattggctgataattatggtaacacaatccatctctttgaaagagattgttctgttcaaagaagacatcaaaaggttgttgaaattgcacctgccaaaactttacctgttgaagttagaaatgctatattaaaggatgctgtaacgttagctaaaaccgctaactatagaaatgctggtactgcagaatttttagttgattcccaaaacagacattattttattgaaattaatccaagaattcaagttgaacatacaattactgaagaaatcacgggtgttgatattgttgccgctcaaattcaaattgctgcaggtgcatcattggaacaattgggtctattacaaaacaaaattacaactagaggttttgcaattcaatgtagaattacaaccgaggatcctgctaagaattttgccccagatacaggtaaaattgaggtttatagatctgcaggtggtaacggtgtcagattagatggtggtaatgggtttgccggtgctgttatatctcctcattatgactcgatgttggttaaatgttcaacatctggttctaactatgaaattgccagaagaaagatgattagagctttagttgaatttagaatcagaggtgtcaagaccaatattcctttcttattggcattgctaactcatccagttttcatttcgggtgattgttggacaacttttattgatgataccccttcgttattcgaaatggtttcttcaaagaatagagcccaaaaattattggcatatattggtgacttgtgtgtcaatggttcttcaattaaaggtcaaattggtttccctaaattgaacaaggaagcagaaatcccagatttgttggatccaaatgatgaggttattgatgtttctaaaccttctaccaatggtctaagaccgtatctattaaagtatggaccagatgcgttttccaaaaaagttcgtgaattcgatggttgtatgattatggataccacctggagagatgcacatcaatcattattggctacaagagttagaactattgatttactgagaattgctccaacgactagtcatgccttacaaaatgcatttgcattagaatgttggggtggcgcaacatttgatgttgcgatgaggttcctctatgaagatccttgggagagattaagacaacttagaaaggcagttccaaatattcctttccaaatgttattgagaggtgctaatggtgttgcttattcgtcattacctgataatgcaattgatcattttgttaagcaagcaaaggataatggtgttgatattttcagagtctttgatgctttgaacgatttggaacaattgaaggttggtgttgatgctgtcaagaaagccggaggtgttgttgaagctacagtttgttactcaggtgatatgttaattccaggtaaaaagtataacttggattattatttagagactgttggaaagattgtggaaatgggtacccatattttaggtattaaggatatggctggcacgttaaagccaaaggctgctaagttgttgattggctcgatcagatcaaaataccctgacttggttatccatgtccatacccatgactctgctggtaccggtatttcaacttatgttgcatgcgcattggcaggtgccgacattgtcgattgtgcaatcaattcgatgtctggtttaacctctcaaccttcaatgagtgcttttattgctgctttagatggtgatatcgaaactggtgttccagaacattttgcaagacaattagatgcatactgggcagaaatgagattgttatactcatgtttcgaagccgacttgaagggaccagacccagaagtttataaacatgaaattccaggtggacagttgactaacctaatcttccaagcccaacaagttggtttgggtgaacaatgggaagaaactaagaagaagtatgaagatgctaacatgttgttgggtgatattgtcaaggttaccccaacctccaaggttgttggtgatttagcccaatttatggtttctaataaattagaaaaagaagatgttgaaaaacttgctaatgaattagatttcccagattcagttcttgatttctttgaaggattaatgggtacaccatatggtggattcccagagcctttgagaacaaatgtcatttccggcaagagaagaaaattaaagggtagaccaggtttagaattagaacctttcaacctcgaggaaatcagagaaaatttggtttccagatttggtccaggtattactgaatgtgatgttgcatcttataacatgtatccaaaggtttacgagcaatatcgtaaggtggttgaaaaatatggtgatttatctgttttaccaacaaaagcatttttggctcctccaactattggtgaagaagttcatgtggaaattgagcaaggtaagactttgattattaagttattagccatttctgacttgtctaaatctcatggtacaagagaagtatactttgaattgaatggtgaaatgagaaaggttacaattgaagataaaacagctgcaattgagactgttacaagagcaaaggctgacggacacaatccaaatgaagttggtgcgccaatggctggtgtcgttgttgaagttagagtgaagcatggaacagaagttaagaagggtgatccattagccgttttgagtgcaatgaaaatggaaatggttatttctgctcctgttagtggtagggtcggtgaagtttttgtcaacgaaggcgattccgttgatatgggtgatttgcttgtgaaaattgccaaagatgaagcgccagcagcttaa

SEQ ID NO: 2 - protein, 1180 aa, Issatchenkia orientalis
MSTVEDHSSLHKLRKESEILSNANKILVANRGEIPIRIFRSAHELSMHTVAIYSHEDRLSMHRLKADEAYAIGKTGQYSPVQAYLQIDEIIKIAKEHDVSMIHPGYGFLSENSEFAKKVEESGMIWVGPPAEVIDSVGDKVSARNLAIKCDVPVVPGTDGPIEDIEQAKQFVEQYGYPVIIKAAFGGGGRGMRVVREGDDIVDAFQRASSEAKSAFGNGTCFIERFLDKPKHIEVQLLADNYGNTIHLFERDCSVQRRHQKVVEIAPAKTLPVEVRNAILKDAVTLAKTANYRNAGTAEFLVDSQNRHYFIEINPRIQVEHTITEEITGVDIVAAQIQIAAGASLEQLGLLQNKITTRGFAIQCRITTEDPAKNFAPDTGKIEVYRSAGGNGVRLDGGNGFAGAVISPHYDSMLVKCSTSGSNYEIARRKMIRALVEFRIRGVKTNIPFLLALLTHPVFISGDCWTTFIDDTPSLFEMVSSKNRAQKLLAYIGDLCVNGSSIKGQIGFPKLNKEAEIPDLLDPNDEVIDVSKPSTNGLRPYLLKYGPDAFSKKVREFDGCMIMDTTWRDAHQSLLATRVRTIDLLRIAPTTSHALQNAFALECWGGATFDVAMRFLYEDPWERLRQLRKAVPNIPFQMLLRGANGVAYSSLPDNAIDHFVKQAKDNGVDIFRVFDALNDLEQLKVGVDAVKKAGGVVEATVCYSGDMLIPGKKYNLDYYLETVGKIVEMGTHILGIKDMAGTLKPKAAKLLIGSIRSKYPDLVIHVHTHDSAGTGISTYVACALAGADIVDCAINSMSGLTSQPSMSAFIAALDGDIETGVPEHFARQLDAYWAEMRLLYSCFEADLKGPDPEVYKHEIPGGQLTNLIFQAQQVGLGEQWEETKKKYEDANMLLGDIVKVTPTSKVVGDLAQFMVSNKLEKEDVEKLANELDFPDSVLDFFEGLMGTPYGGFPEPLRTNVISGKRRKLKGRPGLELEPFNLEEIRENLVSRFGPGITECDVASYNMYPKVYEQYRKVVEKYGDLSVLPTKAFLAPPTIGEEVHVEIEQGKTLIIKLLAISDLSKSHGTREVYFELNGEMRKVTIEDKTAAIETVTRAKADGHNPNEVGAPMAGVVVEVRVKHGTEVKKGDPLAVLSAMKMEMVISAPVSGRVGEVFVNEGDSVDMGDLLVKIAKDEAPAA

SEQ ID NO: 3 - protein, 1154 aa, Rhodobacter sphaeroides
MAEFRKILIANRGEIAIRVMRAANEMGKKTVAVYAEEDKLSLHRFKADEAYRIGEGLSPVGAYLSIPEIIRVAQMSGADAIHPGYGLLSENPDFVEACDAAGIAFIGPKAETMRALGDKASARRVAMAAGVPVIPATEVLGDDMEEIKRQAAEIGYPLMLKASWGGGGRGMRPITSEAELADKVREGRREAEAAFGNGEGYLEKMIQRARHVEVQILGDKYGAIYHLYERDCTVQRRNQKVVERAPAPYLTEEQRTEICELGRRICAHVNYECAGTVEFLMDMDSEKFYFIEVNPRVQVEHTVTEEVTGIDIVQSQIRIAEGATLAEATGCPSQDDIKLSGHALQCRVTTEDPQNNFIPDYGRLTAYRSATGMGIRLDGGTAYAGGVITRYYDSLLVKVTAWAPTPEKAIARMDRALREFRIRGVATNIAFVENLLKHPSFLDYSYTTKFIDTTPDLFNFKPRRDRATKILTYIADITVNGHPETAGRVRPSAELKDPKAPEPKGAPQPGTRTLLEEKGPQAVADWMAAQTRVLMTDTTMRDGHQSLLATRMRSIDMIKVTPAYAANLGGLFSVECWGGATFDVAYRFLQECPWQRLRDIRARLPNVMTQMLLRASNGVGYTNYPDNVVQEFVRQAAETGVDVFRVFDSLNWVENMRVAMDAVIEANKVCEGTICYTGDLLDPDRSKYDLNYYVGMGRALRDAGAHVLGLKDMAGLLKPAAARVLVKALKEEVGLPIHFHTHDTSGIAGATVLAACDAGVDAVDAAMDAFSGGTSQPCLGSIVEALKHTDRDTGLDIAAIREISDYWGHVRQQYSAFESGLPSPASEVYLHEMPGGQFTNLKAQARSMGLEERWSEVAQAYADANRMFGDIVKVTPSSKVVGDMALMMVAQGLTREEVEDPEVEVSFPDSVVDMLKGNLGQPHGGWPEPILKKVLKGEAPSTERPGAHLPPVDIAAAREKLLSEIKQGDDDPLDTAVDAEDLNGYLMYPKVFTDYRARHRIYGPVRTLPTRTFFYGMEPGEEISAEIDPGKTLEIRLSAVGETSDDGDAKVFFELNGQPRVIRVANRAVKAKTATRPKAQDGNPAHVGAPMPGSVASVAVSAGQKVKPGDLLVTIEAMKMETGLHADRAATVKAVHVGPGAQIEAKDLLVELED

SEQ ID NO: 4 - protein, 1154 aa, Rhizobium etli
MPISKILVANRSEIAIRVFRAANELGIKTVAIWAEEDKLALHRFKADESYQVGRGPHLARDLGPIESYLSIDEVIRVAKLSGADAIHPGYGLLSESPEFVDACNKAGIIFIGPKADTMRQLGNKVAARNLAISVGVPVVPATEPLPDDMAEVAKMAAAIGYPVMLKASWGGGGRGMRVIRSEADLAKEVTEAKREAMAAFGKDEVYLEKLVERARHVESQILGDTHGNVVHLFERDCSVQRRNQKVVERAPAPYLSEAQRQELAAYSLKIAGATNYIGAGTVEYLMDADTGKFYFIEVNPRIQVEHTVTEVVTGIDIVKAQIHILDGAAIGTPQSGVPNQEDIRLNGHALQCRVTTEDPEHNFIPDYGRITAYRSASGFGIRLDGGTSYSGAIITRYYDPLLVKVTAWAPNPLEAISRMDRALREFRIRGVATNLTFLEAIIGHPKFRDNSYTTRFIDTTPELFQQVKRQDRATKLLTYLADVTVNGHPEAKDRPKPLENAARPVVPYANGNGVKDGTKQLLDTLGPKKFGEWMRNEKRVLLTDTTMRDGHQSLLATRMRTYDIARIAGTYSHALPNLLSLECWGGATFDVSMRFLTEDPWERLALIREGAPNLLLQMLLRGANGVGYTNYPDNVVKYFVRQAAKGGIDLFRVFDCLNWVENMRVSMDAIAEENKLCEAAICYTGDILNSARPKYDLKYYTNLAVELEKAGAHIIAVKDMAGLLKPAAAKVLFKALREATGLPIHFHTHDTSGIAAATVLAAVEAGVDAVDAAMDALSGNTSQPCLGSIVEALSGSERDPGLDPAWIRRISFYWEAVRNQYAAFESDLKGPASEVYLHEMPGGQFTNLKEQARSLGLETRWHQVAQAYADANQMFGDIVKVTPSSKVVGDMALMMVSQDLTVADVVSPDREVSFPESVVSMLKGDLGQPPSGWPEALQKKALKGEKPYTVRPGSLLKEADLDAERKVIEKKLEREVSDFEFASYLMYPKVFTDFALASDTYGPVSVLPTPAYFYGLADGEELFADIEKGKTLVIVNQAVSATDSQGMVTVFFELNGQPRRIKVPDRAHGATGAAVRRKAEPGNAAHVGAPMPGVISRVFVSSGQAVNAGDVLVSIEAMKMETAIHAEKDGTIAEVLVKAGDQIDAKDLLAVYGG

SEQ ID NO: 5 - protein, 602 aa, Pseudomonas fluorescens
MTKKIFVTDTILRDAHQSLLATRMRTEDMLPICDKLDKVGYWSLECWGGATFDACVRFLKEDPWERLRQLRAALPNTRLQMLLRGQNLLGYRHYSDDVVKAFVAKAAVNGIDVFRIFDAMNDVRNLRVAIEAVKAAGKHAQGTIAYTTSPVHTIDAFVAQAKQMEAMGCDSVAIKDMAGLLTPYATGELVRALKAEQSLPVFIHSHDTAGLAAMCQLKAIENGADHIDTAISSFASGTSHPGTESMVAALKGTEFDTGLNLELLQEIGLYFYAVRKKYHQFESEFTAVDTRVQVNQVPGGMISNLANQLKEQGALNRMGEVLAEIPRVREDLGFPPLVTPTSQIVGTQAFFNVLAGERYKTITNEVKLYLQGGYGKAPGTVNEKLRRQAIGSEEVIDVRPADLLKPEMTKLRADIGALAKSEEDVLTFAMFPDIGRKFLEERAAGTLTPEVLLPIPEAGKVASAGGEGVPTEFVIDVHGETYRVDITGVGVKAEGKRHFYLSIDGMPEEVVFEPLNEFVGGGSSKRKQASAPGHVSTTMPGNIVDVLVKEGDTVKAGQAVLITEAMKMETEVQAAIAGKVTAIHVAKGDRVNPGEILIEIEG

SEQ ID NO: 6 - protein, 481 aa, Pseudomonas fluorescens
MVPPAQGNLQVITKILIANRGEIAVRIVRACAEMGIRSVAIYSDADRHALHVKRADEAHSIGAEPLAGYLNPRKLVNLAVETGCDALHPGYGFLSENAELADICAERGIKFIGPSAEVIRRMGDKTEARRSMIKAGVPVTPGTEGNVSGIEEALSEGDRIGYPVMLKATSGGGGRGIRRCNSREELEQNFPRVISEATKAFGSAEVFLEKCIVNPKHIEAQILGDSFGNVVHLFERDCSIQRRNQKLIEIAPSPQLTPEQRAYIGDLSVRAAKAVGYENAGTVEFLLAEGEVYFMEMNTRVQVEHTITEEITGIDIVREQIRIASGLPLSVKQEDIQHRGFALQFRINAEDPKNNFLPSFGKITRYYAPGGPGVRTDTAIYTGYTIPPFYDSMCLKLVVWALTWEEAMDRGLRALDDMRLQGVKTTAAYYQEILRNPEFRSGQFNTSFVESHPELTNYSIKRKPEELALAIAAAIAAHAGL

SEQ ID NO: 7 - protein, 1140 aa, Corynebacterium glutamicum
MSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDEIVKSAEGQTYPIFVKAVAGGGGRGMRFVASPDELRKLATEASREAEAAFGDGAVYVERAVINPQHIEVQILGDHTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIADHPHLLQAPPADDEQGRILDYLADVTVNKPHGVRPKDVAAPIDKLPNIKDLPLPRGSRDRLKQLGPAAFARDLREQDALAVTDTTFRDAHQSLLATRVRSFALKPAAEAVAKLTPELLSVEAWGGATYDVAMRFLFEDPWDRLDELREAMPNVNIQMLLRGRNTVGYTPYPDSVCRAFVKEAASSGVDIFRIFDALNDVSQMRPAIDAVLETNTAVAEVAMAYSGDLSDPNEKLYTLDYYLKMAEEIVKSGAHILAIKDMAGLLRPAAVTKLVTALRREFDLPVHVHTHDTAGGQLATYFAAAQAGADAVDGASAPLSGTTSQPSLSAIVAAFAHTRRDTGLSLEAVSDLEPYWEAVRGLYLPFESGTPGPTGRVYRHEIPGGQLSNLRAQATALGLADRFELIEDNYAAVNEMLGRPTKVTPSSKVVGDLALHLVGAGVDPADFAADPQKYDIPDSVIAFLRGELGNPPGGWPEPLRTRALEGRSEGKAPLTEVPEEEQAHLDADDSKERRNSLNRLLFPKPTEEFLEHRRRFGNTSALDDREFFYGLVEGRETLIRLPDVRTPLLVRLDAISEPDDKGMRNVVANVNGQIRPMRVRDRSVESVTATAEKADSSNKGHVAAPFAGVVTVTVAEGDEVKAGDAVAIIEAMKMEATITASVDGKIDRVVVPAATKVEGGDLIVVVS

SEQ ID NO: 8 - protein, 1152 aa, Sinorhizobium meliloti
MSISKILVANRSEIAIRVFRAANELGLKTVAIWAEEDKLALHRFKADESYQVGRGPHLPRDLGPIMSYLSIDEVIRVAKLSGADAIHPGYGLLSESPEFAEACAANGITFIGPKPETMRQLGNKVAARNLAISIGVPVVPATEPLPDDPEEIKRLAEEIGYPVMLKASWGGGGRGMRAIRDPKDLIREVTEAKREAKAAFGKDEVYLEKLVERARHVESQILGDTHGNVVHLFERDCSIQRRNQKVVERAPAPYLNDAQRQELADYSLKIARATNYIGAGTVEYLMDSDTGKFYFIEVNPRIQVEHTVTEVVTGIDIVKAQIHILDGFAIGAPESGVPRQEDIRLNGHALQCRITTEDPEQNFIPDYGRITAYRGATGFGIRLDGGTAYSGAVITRYYDPLLEKVTAWAPNPGEAIQRMIRALREFRIRGVATNLTFLEAIISHPKFHDNSYTTRFIDTTPELFQQVKRQDRATKLLTYLADVTVNGHPEVKGRPKPSDDIAAPVVPFTGGDVKPGTKQRLDQLGPKKFAEWVKAQPEVLITDTTMRDGHQSLLATRMRTYDIARIAGTYARALPNLFSLECWGGATFDVSMRFLTEDPWERLAMVREGAPNLLLQMLLRGANGVGYKNYPDNVVKYFVRQAAKGGIDVFRVFDCLNWVENMRVAMDAVAEEDRICEAAICYTGDILNSARPKYDLKYYTALAAELEKAGAHMIAVKDMAGLLKPAAARVLFKALKEATGLPIHFHTHDTSGIAAATVLAAVESGVDVVDAAMDALSGNTSQPCLGSIVEALSGSERDPGLDPEWIRRISFYWEAVRHQYAAFESDLKGPASEVYLHEMPGGQFTNLKEQARSLGLETRWHEVAQAYADANRMFGDIVKVTPSSKVVGDMALMMVSQDLTVADVENPGKDIAFPESVVSMLKGDLGQPPGGWPEALQKKALKGEEPYDARPGSLLEDADLDAERKGIEEKLGREVTDFEFASYLMYPKVFTDYAVACETYGPVSVLPTPAYFYGMAPGEELFADIEKGKTLVILNQAQGEIDEKGMVKMFFEMNGQPRSIKVPDRNRGASAAVRRKAEAGNAAHLGAPMPGVISTVAVASGQSVKAGDVLLSIEAMKMETALHAEKDGVISEVLVRAGDQIDAKDLLVVFGG

SEQ ID NO: 9 - DNA, 2652 bp, Escherichia coli
atgaacgaacaatattccgcattgcgtagtaatgtcagtatgctcggcaaagtgctgggagaaaccatcaaggatgcgttgggagaacacattcttgaacgcgtagaaactatccgtaagttgtcgaaatcttcacgcgctggcaatgatgctaaccgccaggagttgctcaccaccttacaaaatttgtcgaacgacgagctgctgcccgttgcgcgtgcgtttagtcagttcctgaacctggccaacaccgccgagcaataccacagcatttcgccgaaaggcgaagctgccagcaacccggaagtgatcgcccgcaccctgcgtaaactgaaaaaccagccggaactgagcgaagacaccatcaaaaaagcagtggaatcgctgtcgctggaactggtcctcacggctcacccaaccgaaattacccgtcgtacactgatccacaaaatggtggaagtgaacgcctgtttaaaacagctcgataacaaagatatcgctgactacgaacacaaccagctgatgcgtcgcctgcgccagttgatcgcccagtcatggcataccgatgaaatccgtaagctgcgtccaagcccggtagatgaagccaaatggggctttgccgtagtggaaaacagcctgtggcaaggcgtaccaaattacctgcgcgaactgaacgaacaactggaagagaacctcggctacaaactgcccgtcgaatttgttccggtccgttttacttcgtggatgggcggcgaccgcgacggcaacccgaacgtcactgccgatatcacccgccacgtcctgctactcagccgctggaaagccaccgatttgttcctgaaagatattcaggtgctggtttctgaactgtcgatggttgaagcgacccctgaactgctggcgctggttggcgaagaaggtgccgcagaaccgtatcgctatctgatgaaaaacctgcgttctcgcctgatggcgacacaggcatggctggaagcgcgcctgaaaggcgaagaactgccaaaaccagaaggcctgctgacacaaaacgaagaactgtgggaaccgctctacgcttgctaccagtcacttcaggcgtgtggcatgggtattatcgccaacggcgatctgctcgacaccctgcgccgcgtgaaatgtttcggcgtaccgctggtccgtattgatatccgtcaggagagcacgcgtcataccgaagcgctgggcgagctgacccgctacctcggtatcggcgactacgaaagctggtcagaggccgacaaacaggcgttcctgatccgcgaactgaactccaaacgtccgcttctgccgcgcaactggcaaccaagcgccgaaacgcgcgaagtgctcgatacctgccaggtgattgccgaagcaccgcaaggctccattgccgcctacgtgatctcgatggcgaaaacgccgtccgacgtactggctgtccacctgctgctgaaagaagcgggtatcgggtttgcgatgccggttgctccgctgtttgaaaccctcgatgatctgaacaacgccaacgatgtcatgacccagctgctcaatattgactggtatcgtggcctgattcagggcaaacagatggtgatgattggctattccgactcagcaaaagatgcgggagtgatggcagcttcctgggcgcaatatcaggcacaggatgcattaatcaaaacctgcgaaaaagcgggtattgagctgacgttgttccacggtcgcggcggttccattggtcgcggcggcgcacctgctcatgcggcgctgctgtcacaaccgccaggaagcctgaaaggcggcctgcgcgtaaccgaacagggcgagatgatccgctttaaatatggtctgccagaaatcaccgtcagcagcctgtcgctttataccggggcgattctggaagccaacctgctgccaccgccggagccgaaagagagctggcgtcgcattatggatgaactgtcagtcatctcctgcgatgtctaccgcggctacgtacgtgaaaacaaagattttgtgccttacttccgctccgctacgccggaacaagaactgggcaaactgccgttgggttcacgtccggcgaaacgtcgcccaaccggcggcgtcgagtcactacgcgccattccgtggatcttcgcctggacgcaaaaccgtctgatgctccccgcctggctgggtgcaggtacggcgctgcaaaaagtggtcgaagacggcaaacagagcgagctggaggctatgtgccgcgattggccattcttctcgacgcgtctcggcatgctggagatggtcttcgccaaagcagacctgtggctggcggaatactatgaccaacgcctggtagacaaagcactgtggccgttaggtaaagagttacgcaacctgcaagaagaagacatcaaagtggtgctggcgattgccaacgattcccatctgatggccgatctgccgtggattgcagagtctattcagctacggaatatttacaccgacccgctgaacgtattgcaggccgagttgctgcaccgctcccgccaggcagaaaaagaaggccaggaaccggatcctcgcgtcgaacaagcgttaatggtcactattgccgggattgcggcaggtatgcgtaataccggctaa

SEQ ID NO: 10 - protein, 883 aa, Escherichia coli
MNEQYSALRSNVSMLGKVLGETIKDALGEHILERVETIRKLSKSSRAGNDANRQELLTTLQNLSNDELLPVARAFSQFLNLANTAEQYHSISPKGEAASNPEVIARTLRKLKNQPELSEDTIKKAVESLSLELVLTAHPTEITRRTLIHKMVEVNACLKQLDNKDIADYEHNQLMRRLRQLIAQSWHTDEIRKLRPSPVDEAKWGFAVVENSLWQGVPNYLRELNEQLEENLGYKLPVEFVPVRFTSWMGGDRDGNPNVTADITRHVLLLSRWKATDLFLKDIQVLVSELSMVEATPELLALVGEEGAAEPYRYLMKNLRSRLMATQAWLEARLKGEELPKPEGLLTQNEELWEPLYACYQSLQACGMGIIANGDLLDTLRRVKCFGVPLVRIDIRQESTRHTEALGELTRYLGIGDYESWSEADKQAFLIRELNSKRPLLPRNWQPSAETREVLDTCQVIAEAPQGSIAAYVISMAKTPSDVLAVHLLLKEAGIGFAMPVAPLFETLDDLNNANDVMTQLLNIDWYRGLIQGKQMVMIGYSDSAKDAGVMAASWAQYQAQDALIKTCEKAGIELTLFHGRGGSIGRGGAPAHAALLSQPPGSLKGGLRVTEQGEMIRFKYGLPEITVSSLSLYTGAILEANLLPPPEPKESWRRIMDELSVISCDVYRGYVRENKDFVPYFRSATPEQELGKLPLGSRPAKRRPTGGVESLRAIPWIFAWTQNRLMLPAWLGAGTALQKVVEDGKQSELEAMCRDWPFFSTRLGMLEMVFAKADLWLAEYYDQRLVDKALWPLGKELRNLQEEDIKVVLAIANDSHLMADLPWIAESIQLRNIYTDPLNVLQAELLHRSRQAEKEGQEPDPRVEQALMVTIAGIAAGMRNTG

SEQ ID NO: 11 - protein, 483 aa, Methanobacterium thermoautotrophicum
MKVPRCMSTQHPDNVNPPFFAEEPELGGEDEIREAYYVFSHLGCDEQMWDCEGKEVDNYVVKKLLTKYQAFFRDHVLGEDLRLTLRVPNPTVERAEAKILLETLESIPRSYDTASLFYGMDAAPVFEVILPMTSSSSCLNRIHSYYLDFVKGKERLQLADGVTVKEWIGEFRPDEINVIPLFEDHEGMLNAAKITGEYLDGKDIQEQRVFLARSDPAMNYGMISATLLNRIALSDFRDLEEESGVKLYPIIGMGSAPFRGNLRPDNVEDVTWEYRGAYTFTVQSSFKYDHEPSDVIRGIKKLRSVKPGRAAEIERESVLEIISAYCREYRRQVMDLVDIINRVARYVPGRRKRKLHIGLFGYSRSMGNVSLPRAITFTAALYSLGVPPELLGFNALSSGDLEFIEEVYPGLGRDLHDAARYANPESPFLSPEVKSSFEEYLEPEYDEGHMKTTEEIIRALRINRTANLQELILEAASQRKFLG

SEQ ID NO: 12 - protein, 537 aa, Clostridium perfringens
MKIPCSMMTQHPDNVETYISIQQEPAEAIKGLTPQDKGGLGIEEVMIDFEGKLTPYHQTSQIALGLISNGIIPGKDVRVTPRIPNANKESVFRQLMSIMSIIETNVQSKELTGTPAISEVVVPMIETGKEISEFQDRVNSVVDMGNKNYKTKLDLNSVRIIPLVEDVPALANIDRILDEHYEIEKSKGHILKDLRIMIARSDTAMSYGLISGVLSVLMAVDGAYKWGEKHGVTISPILGCGSLPFRGHFSEENIDEILATYSGIKTFTFQSALRYDHGEEATKHAVRELKEKIAQSKPRNFSEEDKDLMKEFIGICSKHYLQTFLKVIDTVSFVSDFIPKNRDRLTKAKTGLEYNREVANLDNVADLVKDEVLKQEILSIDNSKEYAVPRAISFTGAMYTLGMPPELMGMGRALNEIKTKYGQEGIDKLLEIYPILRKDLAFAARFANGGVSKKIIDEEARQEYKEDMKYVNEILNLGLDYDFLNENEFYHTLLKTTKPIIMHLMGLEENVMRNSTEELKILNEWIVRMGKVRGSIG

SEQ ID NO: 13 - DNA, 1260 bp, Issatchenkia orientalis
atgtccagaggcttctttactgagaacattacgcaattgccaccagaccctttgtttggtcttaaggccaggttcagcaatgactcacgtgaaaacaaggtcgatttaggtattggggcatatagggacgacaacggtaagccatggatcttaccatctgtcaggttggccgaaaacttgattcagaactccccagactacaaccatgagtacctaccaatcggtggacttgctgatttcacttctgctgcggcaagagttgtatttggaggcgattctaaagccatttcgcaaaaccgtcttgtctccatccagagtttgtcaggtacaggtgccttacatgttgctggtctatttatcaagcgccaatacaagtctcttgatggcacttccgaagaccctctaatatatctatcggaacctacatgggccaaccacgttcaaatctttgaagttattggtctcaagcctgtattctatccatattggcatgccgcaagcaagaccttggatctgaagggctacttaaaggcaataaacgatgctccagaagggtcggtttttgtattgcatgcaacggctcataaccctactggtttggatccaacacaagaacaatggatggagattttggccgctataagtgccaaaaagcatctgccattatttgattgtgcatatcagggtttcacctccgggtctctagatagagatgcttgggctgttcgagaagctgtcaacaatgacaagtacgaattcccgggaattattgtctgtcaatcgtttgcgaaaaatgttggcatgtatggtgaacggattggtgcagttcatattgttctacctgaatcagacgcttccctaaacagcgccatcttctcccaattgcaaaagacaatcagatcggagatttccaatccaccaggatacggtgcaaagattgtgtctaaagttttgaacactccggaactttacaaacagtgggagcaagatttgatcaccatgtcttcgagaatcactgcaatgagaaaggagctagtaaatgagctcgagcgtcttggaacccctggcacttggagacacatcaccgagcaacagggtatgttttcctttactggtttgaacccggagcaggttgccaagctagagaaggagcatggtgtttatcttgttcgtagtggacgtgcaagtattgcaggcctcaacatgggaaacgtcaagtatgttgccaaggccattgactctgtcgtgagagacctttag

SEQ ID NO: 14 - protein, 419 aa, Issatchenkia orientalis
MSRGFFTENITQLPPDPLFGLKARFSNDSRENKVDLGIGAYRDDNGKPWILPSVRLAENLIQNSPDYNHEYLPIGGLADFTSAAARVVFGGDSKAISQNRLVSIQSLSGTGALHVAGLFIKRQYKSLDGTSEDPLIYLSEPTWANHVQIFEVIGLKPVFYPYWHAASKTLDLKGYLKAINDAPEGSVFVLHATAHNPTGLDPTQEQWMEILAAISAKKHLPLFDCAYQGFTSGSLDRDAWAVREAVNNDKYEFPGIIVCQSFAKNVGMYGERIGAVHIVLPESDASLNSAIFSQLQKTIRSEISNPPGYGAKIVSKVLNTPELYKQWEQDLITMSSRITAMRKELVNELERLGTPGTWRHITEQQGMFSFTGLNPEQVAKLEKEHGVYLVRSGRASIAGLNMGNVKYVAKAIDSVVRDL

SEQ ID NO: 15 - protein, 418 aa, Saccharomyces cerevisiae
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 16 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 17 - protein, 139 aa, Streptomyces avermitilis
MLRTMFKSKIHRATVTQADLHYVGSVTIDADLLDAADLLPGELVHIVDITNGARLETYVIEGERGSGVVGINGAAAHLVHPGDLVIIISYAQVSDAEARALRPRVVHVDRDNRVVALGADPAEPVPGSDQARSPQAVTA

SEQ ID NO: 18 - protein, 127 aa, Clostridium acetobutylicum
MHLNMLKSKIHRATVVQADLNYVGSITIDRNLMDKANILEYEKVEIANINNGARFETYVIAGEAGSGIICLNGAAARCAQAGDKVIIMCYCSLTPEEASEHRPKVVFVNDDNSISNVTEYEKHGTIG

SEQ ID NO: 19 - DNA, 1404 bp, Issatchenkia orientalis
atgtctattagtgaaaaatattttcctcaagaacctcaatctcctgaattgaaaactgcaattccaggtcctcaatcaaaggcaaagctcgaggaattatctgctgtctatgatacaaaggctgcatattttgttaccgactactacaaatctcttggtaactatattgtggatgcagatggcaacaagctactagattcttattgccaaatctcttctatcgcattgggttacaataatccagcattattaaaagtagcacattctgatgaaatgacagttgctttatgtaacagacctgctttggcatgttttccatccactgattactatgaaatactaaagaagggattgttgtccgttgctccaaagggattagataaggtttgtactgcacacacgggatctgatgccaatgaaatggcatttaaggctgcatttttgtttcaagcaagtaagaagagaggtgacaaaccatttaccagcgaagagctggaatctgtcatggagaacaagttgccaggcacctctgacatggttatcctgtcatttgaaaaagggttccatggtagattgtttggatctttatctaccactagatctaaagctattcacaaactggatattcctgcgtttgaatggccaaaggctccattccctcagttaaagtatcctctggatcaattccaagctgaaaacaaagcagaagaagaaagatgtttgaaggctttagaggaaattattgtcaactctcctgccaaaattgcagctgcaatcattgaaccggtccaatctgaaggtggtgataatcatgcttcaccagaattcttccaaggtattagagaaatcaccaaaaagcacggtgtcattcttattgttgatgaagttcaaacaggaggtggtgcttctggtaagatgtggttacatgaacactatggcattgtcccagacatcatgactttttctaaaaaaatgcaaaatgcaggtttctttttcagtgaagcaggtcttgctggggaccaaccattcagacaattcaatacctggtgcggtgatccatcaaaagctctaattgcaagaaccataattgaagaaattaaagataagaacctattgactagtgttaccgaaacaggtgactacctatattcaaagctcgaagcaatttcagcaaagtatgacaaaatgatcaacttgagaggtaagggaagaggtttctttattgcatttgatgccccaacaccggagttaagaaacaaatttattgctgaatgtaagaaattaggtttaaacattggtggatgcggtgaacaaggtgttagattgagacctgcattagtttttgaaaagaagcatgctgatatcttagcctccattattgatcaagctttttccaaaatttaa

SEQ ID NO: 20 - protein, 467 aa, Issatchenkia orientalis
MSISEKYFPQEPQSPELKTAIPGPQSKAKLEELSAVYDTKAAYFVTDYYKSLGNYIVDADGNKLLDSYCQISSIALGYNNPALLKVAHSDEMTVALCNRPALACFPSTDYYEILKKGLLSVAPKGLDKVCTAHTGSDANEMAFKAAFLFQASKKRGDKPFTSEELESVMENKLPGTSDMVILSFEKGFHGRLFGSLSTTRSKAIHKLDIPAFEWPKAPFPQLKYPLDQFQAENKAEEERCLKALEEIIVNSPAKIAAAIIEPVQSEGGDNHASPEFFQGIREITKKHGVILIVDEVQTGGGASGKMWLHEHYGIVPDIMTFSKKMQNAGFFFSEAGLAGDQPFRQFNTWCGDPSKALIARTIIEEIKDKNLLTSVTETGDYLYSKLEAISAKYDKMINLRGKGRGFFIAFDAPTPELRNKFIAECKKLGLNIGGCGEQGVRLRPALVFEKKHADILASIIDQAFSKI

SEQ ID NO: 21 - protein, 475 aa, Saccharomyces kluyveri
MPSYSVAELYYPDEPTEPKISTSSYPGPKAKQELEKLSNVFDTRAAYLLADYYKSRGNYIVDQDGNVLLDVYAQISSIALGYNNPEILKVAKSDAMSVALANRPALACFPSNDYGQLLEDGLLKAAPQGQDKIWTALSGSDANETAFKACFMYQAAKKRNGRSFSTEELESVMDNQLPGTSEMVICSFEKGFHGRLFGSLSTTRSKPIHKLDIPAFNWPKAPFPDLKYPLEENKEANKAEESSCIEKFSQIVQEWQGKIAAVIIEPIQSEGGDNHASSDFFQKLREITIENGILMIVDEVQTGVGATGKMWAHEHWNLSNPPDLVTFSKKFQAAGFYYHDPKLQPDQPFRQFNTWCGDPSKALIAKVIYEEIVKHDLVTRTAEVGNYLFNRLEKLFEGKNYIQNLRGKGQGTYIAFDFGTSSERDSFLSRLRCNGANVAGCGDSAVRLRPSLTFEEKHADVLVSIFDKTLRQLYG

SEQ ID NO: 22 - protein, 451 aa, Streptomyces avermitilis
MTPQPNPQVGAAVKAADRAHVFHSWSAQELIDPLAVAGAEGSYFWDYDGRRYLDFTSGLVFTNIGYQHPKVVAAIQEQAASLTTFAPAFAVEARSEAARLIAERTPGDLDKIFFTNGGADAIEHAVRMARIHTGRPKVLSAYRSYHGGTQQAVNITGDPRRWASDSASAGVVHFWAPYLYRSRFYAETEQQECERALEHLETTIAFEGPGTIAAIVLETVPGTAGIMVPPPGYLAGVRELCDKYGIVFVLDEVMAGFGRTGEWFAADLFDVTPDLMTFAKGVNSGYVPLGGVAISGKIAETFGKRAYPGGLTYSGHPLACAAAVATINVMAEEGVVENAANLGARVIEPGLRELAERHPSVGEVRGVGMFWALELVKDRETREPLVPYNAAGEANAPMAAFGAAAKANGLWPFINMNRTHVVPPCNVTEAEAKEGLAALDAALSVADEYTV

SEQ ID NO: 23 - protein, 419 aa, Streptomyces avermitilis
MSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 24 - protein, 471 aa, Saccharomyces cerevisiae
MSICEQYYPEEPTKPTVKTESIPGPESQKQLKELGEVFDTRPAYFLADYEKSLGNYITDVDGNTYLDLYAQISSIALGYNNPALIKAAQSPEMIRALVDRPALGNFPSKDLDKILKQILKSAPKGQDHVWSGLSGADANELAFKAAFIYYRAKQRGYDADFSEKENLSVMDNDAPGAPHLAVLSFKRAFHGRLFASGSTTCSKPIHKLDFPAFHWPHAEYPSYQYPLDENSDANRKEDDHCLAIVEELIKTWSIPVAALIIEPIQSEGGDNHASKYFLQKLRDITLKYNVVYIIDEVQTGVGATGKLWCHEYADIQPPVDLVTFSKKFQSAGYFFHDPKFIPNKPYRQFNTWCGEPARMIIAGAIGQEISDKKLTEQCSRVGDYLFKKLEGLQKKYPENFQNLRGKGRGTFIAWDLPTGEKRDLLLKKLKLNGCNVGGCAVHAVRLRPSLTFEEKHADIFIEALAKSVNEL

SEQ ID NO: 25 - DNA, 813 bp, Issatchenkia orientalis
atgtttggtaatatttcccaaagacttgcaggcaagaacatcctaattacaggtgcgtccactggtatcggataccatacagcaaagtattttgcagaagctgcaaatggagacttgaagttggttttggctgcaagaagaaaggagaagctggaggcactaaaggcagacttgcttgccaagtatccatccatcaaagtccatattgagagtttggatgtctccaaaacggaaaccattgcacctttcttaaaaggtttacctgaggaattttcaattgtcgacgtgttggtcaacaatgcaggtaaggcgcttggtttggatccaattggctctgtcgatccaaaggacgtggatgaaatgttccagaccaatgttttgggtatgattcaattgacccagttggttgtacagcaaatgaaggagagaaactccggggacattgtccaactaggttcagtggctggtagaaacccatacccaggtggtggtatctactgtgcctccaaggccgcattgagatcttttacacatgtattgagagaggaattgattaataccaagattagagtgattgaaatcgagcctggaaatgttgcaactgaggaattttctttgaccagattcaaaggtgataagtccaaggccgaaaaggtctatgagggaaccgagccattgtatggtaccgatattgcagaattgattctatttgcagtttctagacctcaaaacactgttattgcagaaacacttgtttttgctagtaaccaagcttctgcttaccatattttcagaggatcattagataaatag

SEQ ID NO: 26 - protein, 270 aa, Issatchenkia orientalis
MFGNISQRLAGKNILITGASTGIGYHTAKYFAEAANGDLKLVLAARRKEKLEALKADLLAKYPSIKVHIESLDVSKTETIAPFLKGLPEEFSIVDVLVNNAGKALGLDPIGSVDPKDVDEMFQTNVLGMIQLTQLVVQQMKERNSGDIVQLGSVAGRNPYPGGGIYCASKAALRSFTHVLREELINTKIRVIEIEPGNVATEEFSLTRFKGDKSKAEKVYEGTEPLYGTDIAELILFAVSRPQNTVIAETLVFASNQASAYHIFRGSLDK

SEQ ID NO: 27 - protein, 248 aa, Escherichia coli
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 28 - protein, 298 aa, Alcaligenes faecalis
MSNTIAFIGLGHMGKPMALNLLKAGHSLNVFDLNAQAMQELQAAGAQVGESAVQIAQDAQMVFTMLPAGRHVRQVYEGENGLLQTVAPGTVLVDCSTIDAQTSQDLAAKASKLGLFMLDAPVSGGTGGAIAGTLTFMVGGEDQALEKARPYLDAMGKNIFHAGKAGAGQVAKICNNMLLGILMAGTAEALALGVAHGLDPAVLSTIMARSSGRNWATELYNPWPGVMPDVPASRDYQGGFATGLMLKDLGLAADAAVSQNSATPLGELARNLFALHAAQGQNAGLDFSSILNLYRQKH

SEQ ID NO: 29 - protein, 314 aa, Metallosphaera sedula
MTEKVSVVGAGVIGVGWATLFASKGYSVSLYTEKKETLDKGIEKLRNYVQVMKNNSQITEDVNTVISRVSPTTNLDEAVRGANFVIEAVIEDYDAKKKIFGYLDSVLDKEVILASSTSGLLITEVQKAMSKHPERAVIAHPWNPPHLLPLVEIVPGEKTSMEVVERTKSLMEKLDRIVVVLKKEIPGFIGNRLAFALFREAVYLVDEGVATVEDIDKVMTAAIGLRWAFMGPFLTYHLGGGEGGLEYFFNRGFGYGANEWMHTLAKYDKFPYTGVTKAIQQMKEYSFIKGKTFQEISKWRDEKLLKVYKLVWEK

SEQ ID NO: 30 - protein, 295 aa, Pseudomonas putida
MRIAFIGLGNMGAPMARNLIKAGHQLNLFDLNKAVLAELAELGGQISPSPKDAAANSELVITMLPAAAHVRSVYLNEDGVLAGIRPGTPTVDCSTIDPQTARDVSKAAAAKGVDMGDAPVSGGTGGAAAGTLTFMVGASTELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKD

SEQ ID NO: 31 - protein, 295 aa, Pseudomonas putida
MRIAFIGLGNMGAPMARNLIKAGHQLNLFDLNKTVLAELAELGGQISPSPKDAAASSELVITMLPAAAHVRSVYLNDDGVLAGIRPGTPTVDCSTIDPQTARDVSKAAAAKGVDMGDAPVSGGTGGAAAGTLTFMVGASAELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKD

SEQ ID NO: 32 - protein, 298 aa, Pseudomonas aeruginosa
MTDIAFLGLGNMGGPMAANLLKAGHRVNVFDLQPKAVLGLVEQGAQGADSALQCCEGAEVVISMLPAGQHVESLYLGDDGLLARVAGKPLLIDCSTIAPETARKVAEAAAAKGLTLLDAPVSGGVGGARAGTLSFIVGGPAEGFARARPVLENMGRNIFHAGDHGAGQVAKICNNMLLGILMAGTAEALALGVKNGLDPAVLSEVMKQSSGGNWALNLYNPWPGVMPQAPASNGYAGGFQVRLMNKDLGLALANAQAVQASTPLGALARNLFSLHAQADAEHEGLDFSSIQKLYRGKD

SEQ ID NO: 33 - protein, 382 aa, Ralstonia eutropha
MAFIYYLTHIHLDFGAVSLLKSECERIGIRRPLLVTDKGVVAAGVAQRAIDAMQGLQVAVFDETPSNPTEAMVRKAAAQYREAGCDGLVAVGGGSSIDLAKGIAILATHEGELTTYATIEGGSARITDKAAPLIAVPTTSGTGSEVARGAIIILDDGRKLGFHSWHLLPKSAVCDPELTLGLPAGLTAATGMDAIAHCIETFLAPAFNPPADGIALDGLERGWGHIERATRDGQDRDARLNMMSASMQGAMAFQKGLGCVHSLSHPLGGLKIDGRTGLHHGTLNAVVMPAVLRFNADAPTVVRDDRYARLRRAMHLPDGADIAQAVHDMTVRLGLPTGLRQMGVTEDMFDKVIAGALVDHCHKTNPKEASAADYRRMLEQSM

SEQ ID NO: 34 - protein, 371 aa, Clostridium kluyveri
MKLLKLAPDVYKFDTAEEFMKYFKVGKGDFILTNEFLYKPFLEKFNDGADAVFQEKYGLGEPSDEMINNIIKDIGDKQYNRIIAVGGGSVIDIAKILSLKYTDDSLDLFEGKVPLVKNKELIIVPTTCGTGSEVTNVSVAELKRRHTKKGIASDELYATYAVLVPEFIKGLPYKFFVTSSVDALIHATEAYVSPNANPYTDMFSVKAMELILNGYMQMVEKGNDYRVEIIEDFVIGSNYAGIAFGNAGVGAVHALSYPIGGNYHVPHGEANYLFFTEIFKTYYEKNPNGKIKDVNKLLAGILKCDESEAYDSLSQLLDKLLSRKPLREYGMKEEEIETFADSVIEGQQRLLVNNYEPFSREDIVNTYKKLY

SEQ ID NO: 35 - protein, 538 aa, Mannheimia succiniciproducens
MTDLNQLTQELGALGIHDVQEVVYNPSYELLFAEETKPGLEGYEKGTVTNQGAVAVNTGIFTGRSPKDKYIVLDDKTKDTVWWTSEKVKNDNKPMSQDTWNSLKGLVADQLSGKRLFVVDAFCGANKDTRLAVRVVTEVAWQAHFVTNMFIRPSAEELKGFKPDFVVMNGAKCTNPNWKEQGLNSENFVAFNITEGVQLIGGTWYGGEMKKGMFSMMNYFLPLRGIASMHCSANVGKDGDTAIFFGLSGTGKTTLSTDPKRQLIGDDEHGWDDEGVFNFEGGCYAKTINLSAENEPDIYGAIKRDALLENVVVLDNGDVDYADGSKTENTRVSYPIYHIQNIVKPVSKAGPATKVIFLSADAFGVLPPVSKLTPEQTKYYFLSGFTAKLAGTERGITEPTPTFSACFGAAFLSLHPTQYAEVLVKRMQESGAEAYLVNTGWNGTGKRISIKDTRGIIDAILDGSIDKAEMGSLPIFDFSIPKALPGVNPAILDPRDTYADKAQWEEKAQDLAGRFVKNFEKYTGTAEGQALVAAGPKA

SEQ ID NO: 36 - protein, 532 aa, Anaerobiospirillum succiniciproducens
MSLSESLAKYGITGATNIVHNPSHEELFAAETQASLEGFEKGTVTEMGAVNVMTGVYTGRSPKDKFIVKNEASKEIWWTSDEFKNDNKPVTEEAWAQLKALAGKELSNKPLYVVDLFCGANENTRLKIRFVMEVAWQAHFVTNMFIRPTEEELKGFEPDFVVLNASKAKVENFKELGLNSETAVVFNLAEKMQIILNTWYGGEMKKGMFSMMNFYLPLQGIAAMHCSANTDLEGKNTAIFFGLSGTGKTTLSTDPKRLLIGDDEHGWDDDGVFNFEGGCYAKVINLSKENEPDIWGAIKRNALLENVTVDANGKVDFADKSVTENTRVSYPIFHIKNIVKPVSKAPAAKRVIFLSADAFGVLPPVSILSKEQTKYYFLSGFTAKLAGTERGITEPTPTFSSCFGAAFLTLPPTKYAEVLVKRMEASGAKAYLVNTGWNGTGKRISIKDTRGIIDAILDGSIDTANTATIPYFNFTVPTELKGVDTKILDPRNTYADASEWEVKAKDLAERFQKNFKKFESLGGDLVKAGPQL

SEQ ID NO: 37 - protein, 538 aa, Actinobacillus succinogenes
MTDLNKLVKELNDLGLTDVKEIVYNPSYEQLFEEETKPGLEGFDKGTLTTLGAVAVDTGIFTGRSPKDKYIVCDETTKDTVWWNSEAAKNDNKPMTQETWKSLRELVAKQLSGKRLFVVEGYCGASEKHRIGVRMVTEVAWQAHFVKNMFIRPTDEELKNFKADFTVLNGAKCTNPNWKEQGLNSENFVAFNITEGIQLIGGTWYGGEMKKGMFSMMNYFLPLKGVASMHCSANVGKDGDVAIFFGLSGTGKTTLSTDPKRQLIGDDEHGWDESGVFNFEGGCYAKTINLSQENEPDIYGAIRRDALLENVVVRADGSVDFDDGSKTENTRVSYPIYHIDNIVRPVSKAGHATKVIFLTADAFGVLPPVSKLTPEQTEYYFLSGFTAKLAGTERGVTEPTPTFSACFGAAFLSLHPIQYADVLVERMKASGAEAYLVNTGWNGTGKRISIKDTRGIIDAILDGSIEKAEMGELPIFNLAIPKALPGVDPAILDPRDTYADKAQWQVKAEDLANRFVKNFVKYTANPEAAKLVGAGPKA

SEQ ID NO: 38 - protein, 618 aa, Ralstonia eutropha
MNHPSMQGTTALNVPAWVRNQKLVAWVAEIAALTKPERIHWCDGSQEEYDRLCEQMVAAGTLKRLNPAKRKNSYLALSDPSDVARVEDRTFICSQKKEDAGPTNNWVAPAEMRTTLNGLFDGCMRGRTLYVVPFSMGPLGSPIAHIGVELSDSPYVAVNMRIMTRMGKAVYDVLGTDGDFVPCVHTVGKPLAAGEKDVPWPCNPTKYIVHFPESREIWSFGSGYGGNALLGKKCFALRIASTMGRDEGWLAEHMLILGVTSPEGKKFHVAAAFPSACGKTNFAMLIPPKGFEGWKVTTIGDDIAWIKPGKDGRLYAINPEAGYFGVAPGTSEKTNFNAMATLKENVIFTNVALTDDGDVWWEGMTKEAPAHLTDWQGKDWTPEIAKATGAKAAHPNARFTAPASQCPSIDENWDNPAGVPIDAFIFGGRRSTTVPLVTEARNWTEGVYMAATMGSETTAAAAGQQGVVRRDPFAMLPFCGYNMSDYFGHWLALGQKLEAAGAKLPKIYCVNWFRKDADGNFVWPGFGENMRVLSWMIDRVEGKGEGAEHVFGTSPRYEDLNWSGVEFSVAQFTQVTSIDADAWKQELALHDELFTQLKHNLPQALAEARAALGKRLEG

SEQ ID NO: 39 - protein, 540 aa, Escherichia coli
MRVNNGLTPQELEAYGISDVHDIVYNPSYDLLYQEELDPSLTGYERGVLTNLGAVAVDTGIFTGRSPKDKYIVRDDTTRDTFWWADKGKGKNDNKPLSPETWQHLKGLVTRQLSGKRLFVVDAFCGANPDTRLSVRFITEVAWQAHFVKNMFIRPSDEELAGFKPDFIVMNGAKCTNPQWKEQGLNSENFVAFNLTERMQLIGGTWYGGEMKKGMFSMMNYLLPLKGIASMHCSANVGEKGDVAVFFGLSGTGKTTLSTDPKRRLIGDDEHGWDDDGVFNFEGGCYAKTIKLSKEAEPEIYNAIRRDALLENVTVREDGTIDFDDGSKTENTRVSYPIYHIDNIVKPVSKAGHATKVIFLTADAFGVLPPVSRLTADQTQYHFLSGFTAKLAGTERGITEPTPTFSACFGAAFLSLHPTQYAEVLVKRMQAAGAQAYLVNTGWNGTGKRISIKDTRAIIDAILNGSLDNAETFTLPMFNLAIPTELPGVDTKILDPRNTYASPEQWQEKAETLAKLFIDNFDKYTDTPAGAALVAAGPKL

SEQ ID NO: 40 - protein, 236 aa, Lactococcus lactis
MSEITQLFQYNTLGALMAGLYEGTMTIGELLKHGDLGIGTLDSIDGELIVLDGKAYQAKGDKTIVELTDDIKVPYAAVVPHQAEVVFKQKFTVSDKELEDRIESYFDGQNLFRSIKITGKFPKMHVRMIPRAKSGTKFVEVSQNQPEYTEENIKGTIVGIWTPEMFHGVSVAGYHLHFISEDFTFGGHVLDFIIDNGTVEIGAIDQLNQSFPVQDRKFLFADLDIEALKKDIDVAE

SEQ ID NO: 41 - protein, 239 aa, Streptococcus thermophilus
MSEAIKLFQYNTLGALMAGLYGGTLTVGELLEHGDLGLGTLDSIDGELIVLDGKAYQAKGSEGKVEVVEVSPDEKVPYAAVVPHQAEVIFRQRYEMTDKELEDRIESYYDGVNLFRSIKIKGHFKHMHVRMIPKSNADIKFADVATRQPEYEVDDISGTIVGIWTPEMFHGVSVAGYHLHFISDDLTFGGHVMDFVIENGIIEVGPVDQLDQRFPVQDRQYLFAKFNVDEMRKDITKAE

SEQ ID NO: 42 - protein, 285 aa, Brevibacillus brevis
MKKNIITSITSLALVAGLSLTAFAATTATVPAPPAKQESKPAVAANPAPKNVLFQYSTINALMLGQFEGDLTLKDLKLRGDMGLGTINDLDGEMIQMGTKFYQIDSTGKLSELPESVKTPFAVTTHFEPKEKTTLTNVQDYNQLTKMLEEKFENKNVFYAVKLTGTFKMVKARTVPKQTRPYPQLTEVTKKQSEFEFKNVKGTLIGFYTPNYAAALNVPGFHLHFITEDKTSGGHVLNLQFDNANLEISPIHEFDVQLPHTDDFAHSDLTQVTTSQVHQAESERK

SEQ ID NO: 43 - protein, 259 aa, Enterobacter aerogenes
MMMHSSACDCEASLCETLRGFSAQHPDSVIYQTSLMSALLSGVYVGETTIADLLAHGDFGLGTFNELDGEMIAFSSQVYQLRADGSARAAKPEQKTPFAVMTWFQPQYRKTFNGPVSRQQIHDVIDQQIPSDNLFCVRIDGNFRHAHTRTVPRQTPPYRAMTDVLDDQPVFRFNQREGVLVGFRTPQHMQGINVAGYHEHFITDDRQGGGHLLDYQLESGVLTFGEIHKLMIDLPADSAFLQANLHPSNLDAAIRAVEN

SEQ ID NO: 44 - protein, 1231 aa, Mycobacterium tuberculosis
MANISSPFGQNEWLVEEMYRKFRDDPSSVDPSWHEFLVDYSPEPTSQPAAEPTRVTSPLVAERAAAAAPQAPPKPADTAAAGNGVVAALAAKTAVPPPAEGDEVAVLRGAAAAVVKNMSASLEVPTATSVRAVPAKLLIDNRIVINNQLKRTRGGKISFTHLLGYALVQAVKKFPNMNRHYTEVDGKPTAVTPAHTNLGLAIDLQGKDGKRSLVVAGIKRCETMRFAQFVTAYEDIVRRARDGKLTTEDFAGVTISLTNPGTIGTVHSVPRLMPGQGAIIGVGAMEYPAEFQGASEERIAELGIGKLITLTSTYDHRIIQGAESGDFLRTIHELLLSDGFWDEVFRELSIPYLPVRWSTDNPDSIVDKNARVMNLIAAYRNRGHLMADTDPLRLDKARFRSHPDLEVLTHGLTLWDLDRVFKVDGFAGAQYKKLRDVLGLLRDAYCRHIGVEYAHILDPEQKEWLEQRVETKHVKPTVAQQKYILSKLNAAEAFETFLQTKYVGQKRFSLEGAESVIPMMDAAIDQCAEHGLDEVVIGMPHRGRLNVLANIVGKPYSQIFTEFEGNLNPSQAHGSGDVKYHLGATGLYLQMFGDNDIQVSLTANPSHLEAVDPVLEGLVRAKQDLLDHGSIDSDGQRAFSVVPLMLHGDAAFAGQGVVAETLNLANLPGYRVGGTIHIIVNNQIGFTTAPEYSRSSEYCTDVAKMIGAPIFHVNGDDPEACVWVARLAVDFRQRFKKDVVIDMLCYRRRGHNEGDDPSMTNPYVYDVVDTKRGARKSYTEALIGRGDISMKEAEDALRDYQGQLERVFNEVRELEKHGVQPSESVESDQMIPAGLATAVDKSLLARIGDAFLALPNGFTAHPRVQPVLEKRREMAYEGKIDWAFGELLALGSLVAEGKLVRLSGQDSRRGTFSQRHSVLIDRHTGEEFTPLQLLATNSDGSPTGGKFLVYDSPLSEYAAVGFEYGYTVGNPDAVVLWEAQFGDFVNGAQSIIDEFISSGEAKWGQLSNVVLLLPHGHEGQGPDHTSARIERFLQLWAEGSMTIAMPSTPSNYFHLLRRHALDGIQRPLIVFTPKSMLRHKAAVSEIKDFTEIKFRSVLEEPTYEDGIGDRNKVSRILLTSGKLYYELAARKAKDNRNDLAIVRLEQLAPLPRRRLRETLDRYENVKEFFWVQEEPANQGAWPRFGLELPELLPDKLAGIKRISRRAMSAPSSGSSKVHAVEQQEILDEAFG

SEQ ID NO: 45 - protein, 985 aa, Bradyrhizobium japonicum
MSRQDANAAFALSSFLQGTNATYIDEIYARYEKDPSSVDAEWQEFFKSLKDQPDDVRRNAEGPSWERANWPLTPQDDLTSALDGNWAEVEKAVGGKIAAKAQAKGADISSADLLQATRDSVRALMLIRSYRMRGHFHAKLDPLGIEAPRNREELDPRTYGFSEADFDRKIFLDHVLGLEYGTLREITAICERTYCQTLGVEFMHISNAAQKAWIQERIEGPDKEISFTREGRRAILTKLVEAEGFEKFCDTKFTGTKRFGLDGAESLIPALEQIIKRGGNLGVKEIVLGMPHRGRLNVLTQVMGKAHRALFHEFKGGSANPDAVEGSGDVKYHLGASSDREFDGNRIHLSLTANPSHLEIVDPVVLGKVRAKQDQHGDPPDMRISVMPLLMHGDAAFAGQGVVAECFGLSDLKGYRTGGSVHFIVNNQIGFTTYPRYSRSSPYPSDVAKMIDAPIFHVNGDDPEAVVFAAKVATEFRQKFHKPVVIDMFCYRRHGHNEGDEPAFTQPVMYKKIAAHPSTLELYARRLISEGVMTEGEVDKAKADWRARLDAEFEAGTSYKPNKADWLDGKWAGFKIADQEEDARRGVTGVDITALKDIGRKITKVPDGFRVHRTIQRFLENRSKAIDSGAGIDWATGEALAFCSLLNENHHVRLSGQDSERGTFSQRHSVLIDQEDESRYTPFNHLGHEQGHYEVINSLLSEEAVLGFEYGYSLAEPNTLTLWEAQFGDFANGAQVVFDQFISSGERKWLRMSGLVCLLPHGYEGQGPEHSSARLERYLQMCAEDNMQVVYPTTPANYFHVLRRQLHREIRKPLILMTPKSLLRHKRAVSRLEELAKGTTFHRILYDDAQMLPTDAIKLVPDEKIRRIVLCSGKVYYDLYEEREKRGIDDIYLMRVEQLYPVPLKALVAELSRFKKAEVVWCQEEPRNMGAWHFIEPYLEWVLNQVNGVSRRPRYVGRAASAATATGLMSKHQAQLKAFLDEALS

SEQ ID NO: 46 - protein, 995 aa, Rhizobium loti
MARQDQTNDQFSLTSFLYGGNADYIDALYAAYEDDPASVNPEWQEFFAGLKDDAGDVRRNAKGASWAKPSWPLQANGELVSALDGNWGIVEKHLEKKVKDKAVTNGVVLSDADVHQATRDSVRAIMMIRAYRMRGHLHANLDPLGIAKPLEDYNELSPENYGFTAADYDRPIFLDNVLGLEFGTIRQMLEILTRTYCSTLGVEFMHISDPEEKAWIQARIEGADKEISFTNTGKKAILQKLVEAEGFEQFIDVKYKGTKRFGLDGGEALIPALEQIVKRGGQLGMKEIVLGMAHRGRLNVLSQVMAKPHRAIFHEFKGGSAAPDEVEGSGDVKYHLGASSDREFDGNKVHLSLTANPSHLEIVDPVVMGKARAKQDYLFGRGREEIVPLEERAKVLPLLLHGDAAFAGQGVIAEILGLSGLRGHRVAGTLHFIINNQIGFTTNPRFSRSSPYPSDVAKMIEAPIFHVNGDDPEAVVHATKVAIEFRMKFHKPVVVDMFCYRRFGHNEGDEPAFTQPIMYRNIRTHKTTVQIYADRLIAEGHITQAELDQMKADWRAHLESEWEVGQHYKPNKADWLDGAWSGLRTADNQDEQRRGKTAVPVKTLKEIGKKLTEVPKGFEAHKTIIRFLENRREAIESGEGIDWSTAEALAFGAILLDGNPIRLSGQDSERGTFSQRHSVLYDQRDETRYIPLNNLSAAQAGYEVINSMLSEEAVLGFEYGYSLAEPKALTLWEAQFGDFANGAQVVFDQFISSGERKWLRMSGLVCLLPHGYEGQGPEHSSARLERFLQLCAEDNMQVANCTTPANYFHILRRQLKRDFRKPLILMTPKSLLRHKRAVSTLPEISGESSFHRLLWDDAQLLPNQPIKLTKDSKIRRVVLCSGKVYYDLYEEREKRGINDIYLLRVEQLYPFPAKALITELSRFRNAEMVWCQEEPKNMGAWSFIDPYLEWVLAHIDAKHQRVRYTGRPAAASPATGLMSKHLAQLAALLEDALGE

SEQ ID NO: 47 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 48 - DNA, 1728 bp, Issatchenkia orientalis
atgactgacaaaatctccctaggtacttatctgtttgaaaagttaaaggaagcaggctcttattccatctttggtgttcctggtgatttcaatttggcattgttggaccacgtcaaggaagttgaaggcattagatgggtcggtaacgctaacgagttgaatgccggctacgaagctgatggttatgcaagaatcaatggatttgcatccctaatcaccacctttggtgtcggtgaattgtctgccgtcaatgccattgcaggttcttatgctgaacacgtcccattgatccatattgttggtatgccttccttgtctgctatgaagaacaacttgttgttacaccataccttgggtgacacaagattcgacaacttcaccgaaatgtcaaagaaaatcagtgcaaaggttgaaattgtttacgatttggaatcagctccaaaattaattaataacttgattgaaaccgcttatcacacaaagagaccagtctacttgggacttccttccaactttgctgatgaattggttccagcggcattagttaaggaaaacaagttacatttagaagaacctctaaacaaccccgttgctgaagaagaattcattcataacgttgttgaaatggtcaagaaggcagaaaaaccaatcattctcgttgacgcttgtgctgcaagacataacatttctaaggaagtgagagagttggctaaattgactaaattccctgtcttcaccaccccaatgggtaaatctactgttgatgaagatgatgaagaattctttggcttatacttgggttctctatctgctccagatgttaaggacattgttggcccaaccgattgtatcttatccttaggtggtttaccttctgatttcaacaccggttccttctcatatggttacaccactaagaatgtcgttgaattccattccaactactgtaaattcaaatctgcaacttatgaaaacttgatgatgaagggcgcagtccaaagattgatcagcgaattgaagaatattaagtattccaatgtctcaactttatctccaccaaaatctaaatttgcttacgaatctgcaaaggttgctccagaaggtatcatcactcaagattacctgtggaagagattatcttacttcttaaagccaagagatatcattgtcactgaaactggtacttcctcctttggtgtcttggctacccacttaccaagagattcaaagtctatctcccaagtcttatggggttccattggtttctccttaccagctgcagttggtgctgcatttgctgctgaagatgcacacaaacaaactggcgaacaagaaagaagaactgttttgtttattggtgatggttctttacaattgactgtccaatcaatctcagatgctgcaagatggaacatcaagccatacatcttcatcttaaacaacagaggttacactatcgaaaagttgatccacggtcgtcatgaggactacaaccaaattcaaccatgggatcaccaattgttattgaagctctttgctgacaagacccaatatgaaaaccatgttgttaaatccgctaaggacttggacgctttgatgaaggatgaagcattcaacaaggaagataagattagagtcattgaattattcttggatgaattcgatgctccagaaatcttggttgctcaagctaaattatctgatgaaatcaactctaaagccgcttaa

SEQ ID NO: 49 - protein, 575 aa, Issatchenkia orientalis
MTDKISLGTYLFEKLKEAGSYSIFGVPGDFNLALLDHVKEVEGIRWVGNANELNAGYEADGYARINGFASLITTFGVGELSAVNAIAGSYAEHVPLIHIVGMPSLSAMKNNLLLHHTLGDTRFDNFTEMSKKISAKVEIVYDLESAPKLINNLIETAYHTKRPVYLGLPSNFADELVPAALVKENKLHLEEPLNNPVAEEEFIHNVVEMVKKAEKPIILVDACAARHNISKEVRELAKLTKFPVFTTPMGKSTVDEDDEEFFGLYLGSLSAPDVKDIVGPTDCILSLGGLPSDFNTGSFSYGYTTKNVVEFHSNYCKFKSATYENLMMKGAVQRLISELKNIKYSNVSTLSPPKSKFAYESAKVAPEGIITQDYLWKRLSYFLKPRDIIVTETGTSSFGVLATHLPRDSKSISQVLWGSIGFSLPAAVGAAFAAEDAHKQTGEQERRTVLFIGDGSLQLTVQSISDAARWNIKPYIFILNNRGYTIEKLIHGRHEDYNQIQPWDHQLLLKLFADKTQYENHVVKSAKDLDALMKDEAFNKEDKIRVIELFLDEFDAPEILVAQAKLSDEINSKAA

SEQ ID NO: 50 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 51 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 52 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 53 - protein, 557 aa, Acetobacter pasteurianus
MTYTVGMYLAERLVQIGLKHHFAVGGDYNLVLLDQLLLNKDMKQIYCCNELNCGFSAEGYARSNGAAAAVVTFSVGAISAMNALGGAYAENLPVILISGAPNSNDQGTGHILHHTIGKTDYSYQLEMARQVTCAAESITDAHSAPAKIDHVIRTALRERKPAYLDIACNIASEPCVRPGPVSSLLSEPEIDHTSLKAAVDATVALLKNRPAPVMLLGSKLRAANALAATETLADKLQCAVTIMAAAKGFFPEDHAGFRGLYWGEVSNPGVQELVETSDALLCIAPVFNDYSTVGWSGMPKGPNVILAEPDRVTVDGRAYDGFTLRAFLQALAEKAPARPASAQKSSVPTCSLTATSDEAGLTNDEIVRHINALLTSNTTLVAETGDSWFNAMRMTLAGARVELEMQWGHIGWSVPSAFGNAMGSQDRQHVVMVGDGSFQLTAQEVAQMVRYELPVIIFLINNRGYVIEIAIHDGPYNYIKNWDYAGLMEVFNAGEGHGLGLKATTPKELTEAIARAKANTRGPTLIECQIDRTDCTDMLVQWGRKVASTNARKTTLA

SEQ ID NO: 54 - protein, 528 aa, Pseudomonas putida [sequence omitted]

SEQ ID NO: 55 - protein, 528 aa, Pseudomonas aeruginosa
MKTVHSASYEILRRHGLTTVFGNPGSNELPFLKDFPEDFRYILGLHEGAVVGMADGFALASGRPAFVNLHAAAGTGNGMGALTNAWYSHSPLVITAGQQVRSMIGVEAMLANVDAGQLPKPLVKWSHEPACAQDVPRALSQAIQTASLPPRAPVYLSIPYDDWAQPAPAGVEHLAARQVSGAALPAPALLAELGERLSRSRNPVLVLGPDVDGANANGLAVELAEKLRMPAWVAPSASRCPFPTRHACFRGVLPAAIAGISRLLDGHDLILVVGAPVFRYHQFAPGDYLPAGAELVQVTCDPGEAARAPMGDALVGDIALTLEALLEQVRPSARPLPEALPRPPALAEEGGPLRPETVFDVIDALAPRDAIFVKESTSTVTAFWQRVEMREPGSYFFPAAGGLGFGLPAAVGAQLAQPRRQVIGIIGDGSANYGITALWSAAQYRVPAVFIILKNGTYGALRWFAGVLEVPDAPGLDVPGLDFCAIARGYGVEALHAATREELEGALKHALAADRPVLIEVPTQTIEP

SEQ ID NO: 56 - protein, 526 aa, Pseudomonas stutzeri
MASVHSITYELLRRQGIDTVFGNPGSNELPFLKDFPEDFRYILALQEACVVGIADGYAQASRKPAFINLHSAAGTGNAMGAMSNAWNCHSPLIVTAGQQNRAMIGVEALLTNVDAASLPRPLVKWSYEPASAAEVPHAMSRAIHMASMAPRGPVYLSVPYDDWDKEADPQSHHLYDRSVNSAVRLNDQDLEVLVEALNSASNPAIVLGPDVDSANANADCVTLAERLKAPVWVAPSAPRCPFPTRHPCFRGLMPAGIAAISQLLEGHDVVLVIGAPVFRYHQYDPGQYLKPGTRLISITCDPLEAARAPMGDAIVADIGTMTAALASRIGESERQLPAVLPSPERVNQDAGRLRPETVFDTLNEMAPEDAIYLNESTSTTAQMWQRLNMRNPGSYYFCAAGGLGFALPAAIGVQLAEPDRQVIAVIGDGSANYSISALWTAAHYNIPAIFLIMNNGTYGALRWFAGVLEAENVPGLDVPGIDFCAIAKGYGIPALKADNLEQLKGSIHEALSAKGPVLIEVSTVSL

SEQ ID NO: 57 - protein, 528 aa, Pseudomonas fluorescens
MKTVHSASYDILRQQGLTTVFGNPGSNELPFLKGFPEDFRYILGLHEGAVVGMADGFALASGQPAFVNLHAAAGTGNGMGALTNAWYSHSPLVITAGQQVRSMIGVEAMLANVDAPQLPKPLVKWSAEPACAEDVPRALSQAIHMANQAPKGPVYLSIPYDDWARPAPAGVEHLARRQVATAGLPSAAQLRSLVQRLAAARNPVLVLGPDVDGSRSNHLAVQLAEKLRMPAWVAPSASRCPFPTRHPSFRGVLPAAIAGISRCLADHDLILVVGAPVFRYHQFAPGDYLPAGTELLHITCDPGEAARAPMGDALVGDIVETLQALVWALPDCDRPQPQALPPAAPVEELGGLLRPETVFDVIDELAPKDAIYVKESTSTVGAFWQRVEMREPGSYYFPAAGGLGFGLPAAVGVQLARPERRVIGVIGDGSANYGITALWTAAQYQIPVVFIILKNGTYGALRWFAGVLQVSDAPGLDVPGLDFCAIGRGYGVHSVQANTREAFAQALSEALAGDRPVLIEVPTLTIEP

SEQ ID NO: 58 - protein, 1220 aa, Chloroflexus aurantiacus
MATGESMSGTGRLAGKIALITGGAGNIGSELTRRFLAEGATVIISGRNRAKLTALAEMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWAGENTGGIHWILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLAARDRHKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLAMYLERYGARQVWIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 59 - protein, 1229 aa, Roseiflexus castenholzii
MSTVRRLEGKVALITGGAGNIGEVITRRFLAEGATVVITGRNAEKLAVYRRRLIDEERVAPERVVALRMDGSDIAQVRAGVAQIVHGGTDVPIPLHRIDILVNNAGSAGPRRRLVDIPLEPSEVQPPDSETLAQAVGNLVGITWNLTRAAAPHMPSGSSVINISTIFSRTDYYGRIAYVAPKAALNALSDGLARELGVRGIRVNTIYPGPIESERIYTMFQAMDALKGQPEGDTASGFLRMMRLSRIDQNGEVVKRFPSPVDVANTAVFLASDESAAFTGHAFEVTHGMEVPTESRTTFVSRPGLRSVDATGKVILICAGDQVDDAVALADTLRSCRATVVIGFRDPRALEKASVLLREPRHALAADMYGRPTMTAEARLVRLDPLDPRAAAQTLEQIHAELGAIHHAVVLPGQSRHAPSASLIEVDDQVVERFLHQELVGTIALARELARFWEEYPSGSSMHRVLFVSNPDDQQGNQYSHILRAAVEQLVRVWRHESEYDSVNPAHQQEGQSSAAVWANQLIRYVNNEMANLDFTCAWVAKLLGSDRRIAEINLYLPEEIVGTIGVHNPGFGWAESLFGLHMGKVALITGGSAGIGGQIGRLLALSGAHVMLAARNADQLEQMRASIVREVRDASYPDAESRVAIFPGSDVSDIDGLERLVNHTVRVFGKVDYLINNAGIAGAEEMVIDMPVDAWRHTLRANLISNYALLRRLAPQMKAAGGAYVLNVSSYFGGEKYVAIPYPNRSDYAVSKAGQRAMVESLARFLGPEIQINAIAPGPVEGERLKGAGSRPGLFMRRARLILENKRLNEVFAALLAARHEGATIADLLPDLFANDIQSIANSAAMPAPLRRLATMLRETSDAGGSAQSYLMNATIARKLLNRLENGGYITLHDRRALTVEPPEPFFTEAQIEREAIKVRDGILGMLHLQRMPTEFDVALATVFYLADRNVTGETFHPSGGLRFERTVTEGELFGKPGQQRLERLKGSVVYLIGEHLRQHLVLLARTFLDEIHVARVVLLTETTQAATDLAAELSDYEAAGRFVVIPTCGDIEGGIDRAMAEYGRPGPVISTPFRPLPDRALSARNGDWSSVLTTAEFEELVEQQITHHFRVARKAGLIEGANVTLVTPPTSARSTSEEFALANFVKTTLHALTATAGAESERTVPHVPVNQVDLTRRARSEEPRTPSEEEEELQRFVNAVLLTSAPLPTPLESRYRARIYRGNAITV

SEQ ID NO: 60 - protein, 1217 aa, Erythrobacter sp.
MSKEGNAAKGRLEGKVALITGAAGNLGNEISRAFAREGAFVVMTGRTEERISAAREQLIADTGVAPERIDTAVLDGGNPDSIRAAMAKLRKEYGRIDILINNAGSAGPKQPLHNVPLSPQEMEACGDTETVRDAMLNILGVTWNMARIVAPMMPVGGAMVNISTIFSHTRYYGRTAYVVPKAALNALSNQLASELGPRGIRVNTVFPGPIESDRIRTVFAAMDEVQSQPKDTTANYFTGRMALTRSVNGKVDGKPLPNPKDIAGTCLFLASEEAAGIAGEEVDVTHGLSANRTSASTYMTRPSMRSLDGAGLNIFIVSGENWDDALVAAHTLIGSGAKVRLGLARNADVAQANARLKAQGIGEELTVTRFNRAEPDAMEDALAAFSGDVDGAITGAIILPVKPSGHFTGSLLAADDDTVTKFMDTELVGAIAVSRSLARYWHGREDLQSPPRCVFMTNPGDPLGNSFASVLSAGITQLIRIWRDEERVQAGNGSTEHAVWSNQIVRHTNTEDENTRFASGHATRVLFREQHIAEIDLKLPANISEETGSRKAMVGFAENITGLHLGKVAFITGGSAGIGGQVARLLALAGAKVMMVARRESELVAARDRIVGELQDIGFAGVERRVKYMADIDVSDFASLDKAVDATLEEFGRIDYLINNAGVAGAEDMVIDMEPEAWRFTLDANLISNYHLMQRVVPLMKEQGSGYVLNVSSYFGGEKFLAVAYPNRADYGLSKAGQRAMVEAFSPFLGPEVQCNAIAPGPVDGDRLSGTGGKPGLFQRRAKLILENKRLNAVYSAVIHAIREGGDAAKILTRLSRNSTSTLSHDAEAPEELRKLALDFASQGDGLCTWDQYLLTDAMAQRLLVRLQLGGFLLGSNEWASLSSSEQTWLKLSPPDDKPFLPAAQVDKVANGVGKGVISQLHLGAMPTEAEVAQATVFFLADRAVSGETFMPSGGLRVERSNTEREMFGSPKQERIDKMKGKTVWIIGEHLSDYVAATIEELVSGCGVAKVVLIAKDKSGEKAVRDQLPNDLSKDALEVLIAGDGLEEAMDEALGHWGKPTTVLSMPGEPLPDHLFEGGNPLSTKDFAHMVEANITRHYRVTRKASLYDGCQVVLVSPDVPYGSDGPGVALANFVKTSLHAFTATVAVENERLVHDVPVNQINLTRRVSSEEPRDADEHAEELRRFTRAVLLVGAPLPDAQDSRYRSKIYRGTSMTV

SEQ ID NO: 61 - protein, 357 aa, Metallosphaera sedula
MRRTLKAAILGATGLVGIEYVRMLADHPYIKPTYLAGKGSVGKPYGEIVRWQTVGNVPKEVANQEVKPTDPKLMDDVDIIFSPLPQGAAGPVEEQFAKLGFNVISNSPDHRFDMDVPMIIPEVNPHTVTLIDEQRKRRDWKGFIVTTPLCTAQGAAIPLTPIYQNFKMSGVMITTMQSLSGAGYPGIASLDIVDNALPLGDGYDAKTVKEITRILSEVKRNVQEPGVNEITLDATTHRIATIHGHYEVAYVTFKEDTDVRKVMESMESFKGEPQDLKLPTAPEKPIIVTTQDARPQVFFDRWAGNPPGMSVVVGRLKQVNPRTIRFVSLIHNTVRGAAGGGVLTAELLVEKGYIDKR

SEQ ID NO: 62 - protein, 356 aa, Sulfolobus tokodaii
MRRTLKAAILGATGLVGIEYVRMLSNHPYIKPAYLAGKGSVGKPYGEVVRWQTVGQVPKEIADMEIKPTDPKLMDDVDIIFSPLPQGAAGPVEEQFAKEGFPVISNSPDHRFDPDVPLLVPELNPHTISLIDEQRKRREWKGFIVTTPLCTAQGAAIPLGAIFKDYKMDGAFITTIQSLSGAGYPGIPSLDVVDNILPLGDGYDAKTIKEIFRILSEVKRNVDEPKLEDVSLAATTHRIATIHGHYEVLYVSFKEETAAEKVKETLENFRGEPQDLKLPTAPSKPIIVMNEDTRPQVYFDRWAGDIPGMSVVVGRLKQVNKRMIRLVSLIHNTVRGAAGGGILAAELLVEKGYIEK

SEQ ID NO: 63 - protein, 482 aa, Saccharomyces cerevisiae
MSAFVRVVPRISRSSVLTRSLRLQLRCYASYPEHTIIGMPALSPTMTQGNLAAWTKKEGDQLSPGEVIAEIETDKAQMDFEFQEDGYLAKILVPEGTKDIPVNKPIAVYVEDKADVPAFKDFKLEDSGSDSKTSTKAQPAEPQAEKKQEAPAEETKTSAPEAKKSDVAAPQGRIFASPLAKTIALEKGISLKDVHGTGPRGRITKADIESYLEKSSKQSSQTSGAAAATPAAATSSTTAGSAPSPSSTASYEDVPISTMRSIIGERLLQSTQGIPSYIVSSKISISKLLKLRQSLNATANDKYKLSINDLLVKAITVAAKRVPDANAYWLPNENVIRKFKNVDVSVAVATPTGLLTPIVKNCEAKGLSQISNEIKELVKRARINKLAPEEFQGGTICISNMGMNNAVNMFTSIINPPQSTILAIATVERVAVEDAAAENGFSFDNQVTITGTFDHRTIDGAKGAEFMKELKTVIENPLEMLL

SEQ ID NO: 64 - protein, 420 aa, Saccharomyces cerevisiae
MLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 65 - protein, 366 aa, Saccharomyces cerevisiae
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 66 - protein, 499 aa, Saccharomyces cerevisiae
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 67 - protein, 887 aa, Escherichia coli
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 68 - protein, 630 aa, Escherichia coli
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 69 - protein, 474 aa, Escherichia coli [sequence omitted]

SEQ ID NO: 70 - protein, 371 aa, Bacillus subtilis
MAAKTKKAIVDSKKQFDAIKKQFETFQILNEKGEVVNEAAMPDLTDDQLKELMRRMVFTRVLDQRSISLNRQGRLGFYAPTAGQEASQIATHFALEKEDFVLPGYRDVPQLIWHGLPLYQAFLFSRGHFRGNQMPDDVNALSPQIIIGAQYIQTAGVALGLKKRGKKAVAITYTGDGGASQGDFYEGINFAGAYKAPAIFVVQNNRYAISTPVEKQSAAETIAQKAVAAGIVGVQVDGMDPLAVYAATAEARERAINGEGPTLIETLTFRYGPHTMAGDDPTKYRTKEIENEWEQKDPLVRFRAFLENKGLWSEEEEAKVIEDAKEEIKQAIKKADAEPKQKVTDLMKIMYEKMPHNLEEQFEIYTQKESK

SEQ ID NO: 71 - protein, 325 aa, Bacillus subtilis
MAQMTMIQAITDALRTELKNDENVLVFGEDVGVNGGVFRATEGLQKEFGEDRVFDTPLAESGIGGLALGLGLNGFRPVMEIQFFGFVYEVMDSVSGQMARMRYRSGGRWTSPVTIRSPFGGGVHTPELHADSLEGLVAQQPGIKVVIPSTPYDAKGLLISAIRDNDPVVFLEHMKLYRSFRQEVPEEEYTIELGKADVKREGTDLSIITYGAMVHESLKAADELEKDGISAEVVDLRTVSPLDIDTIIASVEKTGRAIVVQEAQKQAGIAANVVAEINDRAILSLEAPVLRVAAPDTVFPFSQAESVWLPNHKDVLETARKVLEF

SEQ ID NO: 72 - protein, 442 aa, Bacillus subtilis
MAFEFKLPDIGEGIHEGEIVKWFVKPNDEVDEDDVLAEVQNDKAVVEIPSPVKGKVLELKVEEGTVATVGQTIITFDAPGYEDLQFKGSDESDDAKTEAQVQSTAEAGQDVAKEEQAQEPAKATGAGQQDQAEVDPNKRVIAMPSVRKYAREKGVDIRKVTGSGNNGRVVKEDIDSFVNGGAQEAAPQETAAPQETAAKPAAAPAPEGEFPETREKMSGIRKAIAKAMVNSKHTAPHVTLMDEVDVTNLVAHRKQFKQVAADQGIKLTYLPYVVKALTSALKKFPVLNTSIDDKTDEVIQKHYFNIGIAADTEKGLLVPVVKNADRKSVFEISDEINGLATKAREGKLAPAEMKGASCTITNIGSAGGQWFTPVINHPEVAILGIGRIAEKAIVRDGEIVAAPVLALSLSFDHRMIDGATAQNALNHIKRLLNDPQLILMEA

SEQ ID NO: 73 - protein, 470 aa, Bacillus subtilis
MVVGDFPIETDTLVIGAGPGGYVAAIRAAQLGQKVTVVEKATLGGVCLNVGCIPSKALINAGHRYENAKHSDDMGITAENVTVDFTKVQEWKASVVNKLTGGVAGLLKGNKVDVVKGEAYFVDSNSVRVMDENSAQTYTFKNAIIATGSRPIELPNFKYSERVLNSTGALALKEIPKKLVVIGGGYIGTELGTAYANFGTELVILEGGDEILPGFEKQMSSLVTRRLKKKGNVEIHTNAMAKGVEERPDGVTVTFEVKGEEKTVDADYVLITVGRRPNTDELGLEQVGIEMTDRGIVKTDKQCRTNVPNIYAIGDIIEGPPLAHKASYEGKIAAEAIAGEPAEIDYLGIPAVVFSEPELASVGYTEAQAKEEGLDIVAAKFPFAANGRALSLNETDGFMKLITRKEDGLVIGAQIAGASASDMISELSLAIEGGMTAEDIAMTIHAHPTLGEITMEAAEVAIGSPIHIVK

SEQ ID NO: 74 - protein, 2123 aa, Saccharomyces cerevisiae
MRSIRKWAYETFNDEKIIQFVVMATPDDLHANSEYIRMADQYVQVPGGTNNNNYANIDLILDVAEQTDVDAVWAGWGHASENPCLPELLASSQRKILFIGPPGRAMRSLGDKISSTIVAQSAKIPCIPWSGSHIDTIHIDNKTNFVSVPDDVYVRGCCSSPEDALEKAKLIGFPVMIKASEGGGGKGIRRVDNEDDFIALYRQAVNETPGSPMFVMKVVTDARHLEVQLLADQYGTNITLFGRDCSIQRRHQKIIEEAPVTITKPETFQRMERAAIRLGELVGYVSAGTVEYLYSPKDDKFYFLELNPRLQVEHPTTEMISGVNLPATQLQIAMGIPMHMISDIRKLYGLDPTGTSYIDFKNLKRPSPKGHCISCRITSEDPNEGFKPSTGKIHELNFRSSSNVWGYFSVGNNGAIHSFSDSQFGHIFAVGNDRQDAKQNMVLALKDFSIRGEFKTPIEYLIELLETRDFESNNISTGWLDDLILKNLSSDSKLDPTLAIICGAAMKAYVFTEKVRNKYLELLRRGQVPPKDFLKTKFPVDFIFDNNRYLFNVAQSSEEQFILSINKSQCEVNVQKLSSDCLLISVDGKCHTVYWKDDIRGTRLSIDSNTIFLEAELNPTQVISPTPGKLVKYLVRSGDHVFAGQQYAEIEIMKMQMPLVAKSDGVIELLRQPGSIIEAGDVIAKLTLDSPSKANESSLYRGELPVLGPPLIEGSRPNHKLRVLINRLENILNGYHENSGIETTLKELIKILRDGRLPYSEWDSQISTVRNRLPRQLNEGLGNLVKKSVSFPAKELHKLMKRYLEENTNDHVVYVALQPLLKISERYSEGLANHECEIFLKLIKKYYAVEKIFENHDIHEERNLLNLRRKDLTNLKKILCISLSHANVVAKNKLVTAILHEYEPLCQDSSKMSLKFRAVIHDLASLESKWAKEVAVKARSVLLRGIFPPIKKRKEHIKTLLQLHIKDTGAENIHSRNIYSCMRDFGNLIHSNLIQLQDLFFFFGHQDTALSSIASEIYARYAYGNYQLKSIKIHKGAPDLLMSWQFSSLRNYLVNSDGESDEFTKLSKPPSTSGKSSANSFGLLVNMRALESLEKTLDEVYEQIHIPEERLSSGENSLIVNILSPIRYRSENDLIKTLKIKLHENERGLSKLKVNRITFAFIAANAPAVKFYSFDGTTYDEISQIRNMDPSYEAPLELGKMSNYKIRSLPTYDSSIRIFEGISKFTPLDKRFFVRKIINSFMYNDQKTTEENLKAEINAQVVYMLEHLGAVDISNSDLNHIFLSFNTVLNIPVHRLEEIVSTILKTHETRLFQERITDVEICISVECLETKKPAPLRLLISNKSGYVVKIETYYEKIGKNGNLILEPCSEQSHYSQKSLSLPYSVKDWLQPKRYKAQFMGTTYVYDFPGLFHQAAIQQWKRYFPKHKLNDSFFSWVELIEQNGNLIKVNREPGLNNIGMVAFEIMVQTPEYPEGRNMIVISNDITYNIGSFGPREDLFFDRVTNYARERGIPRIYLAANSGAKLGIAEELIPLFRVAWNDPSDPTKGFQYLYLAPKDMQLLKDSGKGNSVVVEHKMVYGEERYIIKAIVGFEEGLGVECLQGSGLIAGATSKAYRDIFTITAVTCRSVGIGSYLVRLGQRTIQVEDKPIILTGASAINKVLGTDIYTSNLQIGGTQIMYKNGIAHLTASNDMKAIEKIMTWLSYVPAKRDMSPPLLETMDRWDRDVDFKPAKQVPYEARWLIEGKWDSNNNFQSGLFDKDSFFETLSGWAKGVIVGRARLGGIPVGVIAVETKTIEEIIPADPANLDSSEFSVKEAGQVWYPNSAFKTAQTINDFNYGEQLPLIILANWRGFSGGQRDMYNEVLKYGSFIVDALVDYKQPILIYIPPFGELRGGSWVVIDPTINPEQMEMYADVESRGGVLEPDGVVSIKYRKEKMIETMIRLDSTYGHLRRTLTEKKLSLEKQNDLTKRLKIRERQLIPIYNQISIQFADLHDRSTRMLVKGVIRNELEWKKSRRFLYWRLRRRLNEGQVIKRLQKKTCDNKTKMKYDDLLKIVQSWYNDLDVNDDRAVVEFIERNSKKIDKNIEEFEISLLIDELKKKFEDRRGNIVLEELTRLVDSKRKR

SEQ ID NO: 75 - protein, 319 aa, Escherichia coli
MSLNFLDFEQPIAELEAKIDSLTAVSRQDEKLDINIDEEVHRLREKSVELTRKIFADLGAWQIAQLARHPQRPYTLDYVRLAFDEFDELAGDRAYADDKAIVGGIARLDGRPVMIIGHQKGRETKEKIRRNFGMPAPEGYRKALRLMQMAERFKMPIITFIDTPGAYPGVGAEERGQSEAIARNLREMSRLGVPVVCTVIGEGGSGGALAIGVGDKVNMLQYSTYSVISPEGCASILWKSADKAPLAAEAMGIIAPRLKELKLIDSIIPEPLGGAHRNPEAMAASLKAQLLADLADLDVLSTEDLKNRRYQRLMSYGYA

SEQ ID NO: 76 - protein, 156 aa, Escherichia coli
MDIRKIKKLIELVEESGISELEISEGEESVRISRAAPAASFPVMQQAYAAPMMQQPAQSNAAAPATVPSMEAPAAAEISGHIVRSPMVGTFYRTPSPDAKAFIEVGQKVNVGDTLCIVEAMKMMNQIEADKSGTVKAILVESGQPVEFDEPLVVIE

SEQ ID NO: 77 - protein, 449 aa, Escherichia coli
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKAETIRLMGDKVSAIAAMKKAGVPCVPGSDGPLGDDMDKNRAIAKRIGYPVIIKASGGGGGRGMRVVRGDAELAQSISMTRAEAKAAFSNDMVYMEKYLENPRHVEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVHVRGHAVECRINAEDPNTFLPSPGKITRFHAPGGFGVRWESHIYAGYTVPPYYDSMIGKLICYGENRDVAIARMKNALQELIIDGIKTNVDLQIRIMNDENFQHGGTNIHYLEKKLGLQEK

SEQ ID NO: 78 - protein, 304 aa, Escherichia coli
MSWIERIKSNITPTRKASIPEGVWTKCDSCGQVLYRAELERNLEVCPKCDHHMRMTARNRLHSLLDEGSLVELGSELEPKDVLKFRDSKKYKDRLASAQKETGEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPEAPREGVVVPPVPDQEPEA

SEQ ID NO: 79 - protein, 282 aa, Chloroflexus aurantiacus
MEETAIPQSLTPWDRVQLARHPQRPHTLDYIAALCEDFVELHGDRRFGDDPAMVGGMATFAGQTVMVIGHQKGNDTRENMRRNFGMPHPEGYRKAQRLMRHAEKFGLPVICFVDTPAADPTKSSEERGQANAIAESIMLMTTLRVPSIAVVIGEGGSGGALAISVADRILMQENAIYSVAPPEAAASILWRDAAKAPEAARALKLTAADLYDLRIIDEVIPEPPGGAHADRLTAITTVGERLRVHLADLQQRDIDTLLRERYRKYRSMGQYQEQQMDFFGRM

SEQ ID NO: 80 - protein, 180 aa, Chloroflexus aurantiacus
MMLWGAMKDETTELPADQPDPFGLAAVRVLLQMLEQSDVYEITIENGNAKLHVKRGQPGGVIYSAPLPTAPVPSPSLPATPVTPFVQPPPAPEGPPVEMPAGHTITAPMVGTFYAAPSPRDRPFVQEGDEVRVGDTVGIVEAMKMMNEIESDVAGRVARILVKNGQPVEYGQPLMVIEPL

SEQ ID NO: 81 - protein, 455 aa, Chloroflexus aurantiacus
MIRKVLVANRGEIAVRIIRACQELGIRTVVAYSTADRDSLAVRLADEAVCIGPPPAAKSYLNAPALISAALVSGCDAIHPGYGFLSENPYFAEMCADCKLTFIGPPPEPIRLMGDKAIGRETMRKAGVPTVPGSDGEVRSLEEAIDVARQIGYPVLLKPSGGGGGRGMRVAYDEADLQRAFPTARAEAEAAFGNGALLLEKYLTRVRHVEIQVLADQYGHAIHLGERDCSAQRRHQKIVEEAPSPAVTPELRERMGADAVRGIKSIGYVNAGTLEFLLDQDGNYYFIEMNTRIQVEHPVTEQVTGIDLVRWQLLIASGERLTLRQEDIKITRHAIECRINAEDPERDFLPASGEVEFYLPPGGPGVRVDSHLYSGYTPPGTYDSLLAKIITFGDTRDEALNRMRRALNECVITGIKTTIPFQLALIDDPEFRAGRIHTGYVAELLRQWKETLNPV

SEQ ID NO: 82 - protein, 305 aa, Chloroflexus aurantiacus
MKEFFRLSRKGFTGREDQDSAQIPDDLWVKCSSCRELIYKKQLNDNLKVCPKCGHHMRLSAHEWLGLLDVGSFREMDANLLPTDPLGFVTDEESYAAKLAKTQQRTGMADAVIAGIGAISNMQICVAVADFSFMGASMGSVYGEKMARSAERAAELGVPLLTINTSGGARQQEGVIGLMQMAKVTMALTRLADAGQPHIALLVDPCYGGVTASYPSVADIIIAEPGANIGFAGKRLIEQIMRQKLPAGFQTAEFMLEHGMIDMVVPRSEMRDTLARILRLYRQRSTSPAKAELAGRRATLPQPIM

SEQ ID NO: 83 - protein, 378 aa, Bacillus subtilis
MIIGVPKEIKNNENRVALTPGGVSQLISNGHRVLVETGAGLGSGFENEAYESAGAEIIADPKQVWDAEMVMKVKEPLPEEYVYFRKGLVLFTYLHLAAEPELAQALKDKGVTAIAYETVSEGRTLPLLTPMSEVAGRMAAQIGAQFLEKPKGGKGILLAGVPGVSRGKVTIIGGGVVGTNAAKMAVGLGADVTIIDLNADRLRQLDDIFGHQIKTLISNPVNIADAVAEADLLICAVLIPGAKAPTLVTEEMVKQMKPGSVIVDVAIDQGGIVETVDHITTHDQPTYEKHGVVHYAVANMPGAVPRTSTIALTNVTVPYALQIANKGAVKALADNTALRAGLNTANGHVTYEAVARDLGYEYVPAEKALQDESSVAGA

SEQ ID NO: 84 - protein, 505 aa, Schizosaccharomyces pombe
MFTDYPNDINCESPRMSDLDGFCQNAFSDLNSLNQQVFKANYAVRGALAILADEIQDDLLENPSSYPFSEIVYANIGNPQQMGQSPITFVRQVLSLCQYPTLLDHAEEKWFQNLFPTDVVQRSKMLLKESGSLGAYSASQGIPLVRRHVADFIRARDGFDCEPSDIYLTSGASHAARLIMTLIIARPTDGVMVPAPQYPLYGAQIDLMSGSMVSYSLSEENNWDIDFDQFKKSFDEASKKGINVRLCVVINPGNPTGACISENSMEKVLRFAKAKGIVLLADEVYQNNIYQNKFHSFRRKLGELREKEPDNHWDQVSLISVNSVSKGQFGECGQRGGYLDVVNIPEPAKDQILKLATIDICPPVAGQLLVDMLVNPPKPGDPSYDLFIKEVDEIHEALRLQCRQLYEGTKRMKRVSCLEPHGAMYLHPSVSLPEKLITTAKAQKIQPDEFYAIELLKRSGICVVPGSGFGQPEGDYHIRITFLAKGTEYIERFVKAHNEIMDLYE

SEQ ID NO: 85 - protein, 507 aa, Saccharomyces cerevisiae
MTMTHQQDLKGVFTAKDLDFKPAGKITKKDLNTGVTKAEYAVRGAIPTRADELKEELKKNPEVLPFDDIINANIGNPQQLDQKPLTFTRQVLAILEYPEILRVGHNELASLNLFSRDALERAERLLNDIGGSIGAYSHSQGVPGIRQTVADFITRRDGGEPATPEDIYLTTGASSAATSLLSLLCKDSQTGLLIPIPQYPLYTASASLFNAQVLPYYLDEESNWSTNSDEIEKVVQDALKKQIRPSVLIVINPGNPTGAVLSEETIARICLIAAKYGITIISDEVYQENIFNDVKFHSMKKVLRKLQHLYPGKFDNVQLASLHSISKGFMDECGQRGGYMEIIGFSQEIRDALFKLMSISICSVVTGQAVVDLMVKPPQPGDESYEQDHDERLKIFHEMRTRANLLYETFKELEGIECQKPQGAMYLFPRLVLPKKALCESERLGIEPDEFYCTSLLESTGICTVPGSGFGQRPGTYHVRTTFLAPGTKWIQDWKEFHQDFFSKYRN

SEQ ID NO: 86 - protein, 471 aa, Bacillus subtilis
MKNKWYKPKRHWKEIELWKDVPEEKWNDWLWQLTHTVRTLDDLKKVINLTEDEEEGVRISTKTIPLNITPYYASLMDPDNPRCPVRMQSVPLSEEMHKTKYDLEDPLHEDEDSPVPGLTHRYPDRVLFLVTNQCSMYCRYCTRRRFSGQIGMGVPKKQLDAAIAYIRETPEIRDCLISGGDGLLINDQILEYILKELRSIPHLEVIRIGTRAPVVFPQRITDHLCEILKKYHPVWLNTHFNTSIEMTEESVEACEKLVNAGVPVGNQAVVLAGINDSVPIMKKLMHDLVKIRVRPYYIYQCDLSEGIGHFRAPVSKGLEIIEGLRGHTSGYAVPTFVVDAPGGGGKIALQPNYVLSQSPDKVILRNFEGVITSYPEPENYIPNQADAYFESVFPETADKKEPIGLSAIFADKEVSFTPENVDRIKRREAYIANPEHETLKDRREKRDQLKEKKFLAQQKKQKETECGGDSS

SEQ ID NO: 87 - protein, 416 aa, Porphyromonas gingivalis
MAESRRKYYFPDVTDEQWNDWHWQVLNRIETLDQLKKYVTLTAEEEEGVKESLKVLRMAITPYYLSLIDPENPNCPIRKQAIPTHQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVDAPGGGGKIPVMPNYVVSQSPRHVVLRNYEGVITTYTEPENYHEECDCEDCRAGKHKEGVAALSGGQQLAIEPSDLARKKRKFDKN

SEQ ID NO: 88 - protein, 425 aa, Fusobacterium nucleatum
MNTVNTRKKFFPNVTDEEWNDWTWQVKNRIEKIDDLKKYVELSAEEEEGVVRTLETLRMAITPYYFSLIDMNSDRCPIRKQAIPTIQEIHQSDADLLDPLHEDEDSPVPGLTHRYPDRVLLLITDMCSMYCRHCTRRRFAGSSDDAMPMDRIDKAIEYIAKTPQVRDVLLSGGDALLVSDKKLESIIQKLRAIPHVEIIRIGSRTPVVLPQRITPELCNMLKKYHPIWLNTHFNHPQEVTPEAKKACEMLADAGVPLGNQTVLLRGINDSVPVMKRLVHDLVMMRVRPYYIYQCDLSMGLEHFRTPVSKGIEIIEGLRGHTSGYAVPTFVVDAPGGGGKTPVMPQYVISQSPHRVVLRNFEGVITTYTEPENYTHEPCYDEEKFEKMYEISGVYMLDEGLKMSLEPSHLARHERNKKRAEAEGKK

SEQ ID NO: 89 - protein, 517 aa, Megasphaera elsdenii
MRKVEIITAEQAAQLVKDNDTITSIGFVSSAHPEALTKALEKRFLDTNTPQNLTYIYAGSQGKRDGRAAEHLAHTGLLKRAIIGHWQTVPAIGKLAVENKIEAYNFSQGTLVHWFRALAGHKLGVFTDIGLETFLDPRQLGGKLNDVTKEDLVKLIEVDGHEQLFYPTFPVNVAFLRGTYADESGNITMDEEIGPFESTSVAQAVHNCGGKVVVQVKDVVAHGSLDPRMVKIPGIYVDYVVVAAPEDHQQTYDCEYDPSLSGEHRAPEGATDAALPMSAKKIIGRRGALELTENAVVNLGVGAPEYVASVAGEEGIADTITLTVEGGAIGGVPQGGARFGSSRNADAIIDHTYQFDFYDGGGLDIAYLGLAQCDGSGNINVSKFGTNVAGCGGFPNISQQTPNVYFCGTFTAGGLKIAVEDGKVKILQEGKAKKFIKAVDQITFNGSYAARNGKHVLYITERCVFELTKEGLKLIEVAPGIDIEKDILAHMDFKPIIDNPKLMDARLFQDGPMGLKK

SEQ ID NO: 90 - protein, 145 aa, Clostridium propionicum
MVGKKVVHHLMMSAKDAHYTGNLVNGARIVNQWGDVGTELMVYVDGDISLFLGYKDIEFTAPVYVGDFMEYHGWIEKVGNQSYTCKFEAWKVATMVDITNPQDTRATACEPPVLCGRATGSLFIAKKDQRGPQESSFKERKHPGE

SEQ ID NO: 91 - protein, 260 aa, Phytophthora sojae
MAAEYESILTEVRGKVAIITLNRPKALNALCSPLIEELNGAAHAFDADPSIGAIVITGSGSKAFAAGADIKEMATKTFVDAYKSNMFANWGDITKVSKPVIAAVNGYALGGGCELAMLCDLIIAGDSAKFGQPEITLGTIPGCGGTQRLIRAVGKSKAMEMILTGNMIDAQQAERDGLVARVVPADQLLDEALKTANKIASFSQPVVKMAKEAVNAAYEQSLQEGLKYESRLFWSSFATKDQKEGMAAFVEKRKADFKDE

SEQ ID NO: 92 - protein, 258 aa, Chloroflexus aurantiacus
MSEESLVLSTIEGPIAILTLNRPQALNALSPALIDDLIRHLEACDADDTIRVIIITGAGRAFAAGADIKAMANATPIDMLTSGMIARWARIAAVRKPVIAAVNGYALGGGCELAMMCDIIIASENAQFGQPEINLGIIPGAGGTQRLTRALGPYRAMELILTGATISAQEALAHGLVCRVCPPESLLDEARRIAQTIATKSPLAVQLAKEAVRMAAETTVREGLAIELRNFYLLFASADQKEGMQAFIEKRAPNFSGR

SEQ ID NO: 93 - protein, 288 aa, Rhodospirillum rubrum
MAAAPGPPAARPRAARQSRMILPPLREQAQMAYENILVETNGKVGIVTLNRPKALNALSAGLVRDLGAALDAFEADVNVHVIVLTGSDKAFAAGADIKEMAEKSYMDAYLEDFITKGWERVTTCRKPIIAAVAGFALGGGCEMAMMCDFIIAAQNAKFGQPEINLGTLPGAGGTQRLTRFVGKSKAMDMCLTGRMMDADEAWKCGLVSRIVPVDDLKDEVLKIAEAIADKSLPITMMVKEAVNAAYETTLAQGVRFERRLFQASFATDDQKEGMNAFIEKRQPSFTDR

SEQ ID NO: 94 - protein, 258 aa, Rhodobacter capsulatus
MSYQTLIVEIADGVALIRLNRPEALNALNSQLLGELAAALSTLDADPAVRCFVLTGSDKAFAAGADIKEMADKSFVDMLKLDFFGTEGDAILRTRKPVIAAVAGYALGGGCELAMMCDFILCAENAKFGQPEINLGVVAGIGGTQRLTRFVGKSKSMEMHLTGRFMDAAEAERSGLVSRVLPLADLLPEALATARKIAEKSAIATMVAKDCVNRAYETTLREGVLYERRVFHALFATEDQKEGMAAFAEKRPAKFADK

SEQ ID NO: 95 - protein, 290 aa, Homo sapiens
MAALRVLLSCARGPLRPPVRCPAWRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAQDAKQAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 96 - protein, 399 aa, Pseudomonas fluorescens
MRVVLCKFALLRSHDGSSANILIKNNKSRELSMTAQVSTEASHAAILQDEVLAEVRNHIGHLTLNRPAGLNALTLQMVRSLTSQLQAWSDDPQVYAVVLRGAGEKAFCAGGDIRSLYDSFKNGDTLHQDFFVEEYALDLAIHHYRKPVLALMDGFVLGGGMGLVQGADLRVVTERSRLAMPEVAIGYFPDVGGSYFLPRIPGELGIYLGVTGVQIRAADALYCGLADWYLDSHKLADLDQKLDNLRWHDSPLKDLQGALARLAVQQLPDAPLAALRPAIDHFFALPDVPSIVEQLQQVTVADSHEWALNTVSLMQTRSPLAMAVTLEMLRRGRRLSLEQCFALELHLDRQWFERGDLIEGVRALIIDKDKSPRWNPPTLHGLALNHVESFFHHFEKVVK

SEQ ID NO: 97 - protein, 351 aa, Bacillus cereus
MTEQVLFSVSENGVATITLNRPKALNSLSYDMLQPIGQKLKEWEHDERIALIVLKGAGTKGFCAGGDIKTLYEARSNEVALQHAERFFEEEYEIDTYIYQYTKPIIACLDGIVMGGGVGLTNGAKYRIVTERTKWAMPEMNIGFFPDVGAAYFLNKAPGYTGRFVALTASILKASDVLFINAADYFMTSDSLPEFLTELESVNWHKEDDVHTNLKEVIRTFATAPNLESELAPSLEVINSHFAFDTIEEIIHSLEKDESSFALKTKEILLSKSPISLKVTLKQFIDGQDKSVEECFATDLILAKNFMRHEDFFEGVRSVVVDKDQNPNYKYKQLSDVSEEDVNRFFNLLNA

SEQ ID NO: 98 - protein, 381 aa, Homo sapiens
MWRLMSRFNAFKRTNTILHHLRMSKHTDAAEEVLLEKKGCAGVITLNRPKFLNALTLNMIRQIYPQLKKWEQDPETFVIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFFATTPRKTWLLPCINGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 99 - protein, 261 aa, Megasphaera elsdenii
VKTVYTLGIDVGSSSSKAVILEDGKKIVAHAVVEIGTGSTGPERVLDEVFKDTNLKIEDMANIIATGYGRFNVDCAKGEVSEITCHAKGALFECPGTTTILDIGGQDVKSIKLNGQGLVMQFAMNDKCAAGTGRFLDVMSKVLEIPMSEMGDWYFKSKHPAAVSSTCTVFAESEVISLLSKNVPKEDIVAGVHQSIAAKACALVRRVGVGEDLTMTGGGSRDPGVVDAVSKELGIPVRVALHPQAVGALGAALIAYDKIKK

SEQ ID NO: 100 - protein, 428 aa, Megasphaera elsdenii
MSEEKTVDIESMSSKEALGYFLPKVDEDARKAKKEGRLVCWSASVAPPEFCTAMDIAIVYPETHAAGIGARHGAPAMLEVAENKGYNQDICSYCRVNMGYMELLKQQALTGETPEVLKNSPASPIPLPDVVLTCNNICNTLLKWYENLAKELNVPLINIDVPFNHEFPVTKHAKQYIVGEFKHAIKQLEDLCGRPFDYDKFFEVQKQTQRSIAAWNKIATYFQYKPSPLNGFDLFNYMGLAVAARSLNYSEITFNKFLKELDEKVANKKWAFGENEKSRVTWEGIAVWIALGHTFKELKGQGALMTGSAYPGMWDVSYEPGDLESMAEAYSRTYINCCLEQRGAVLEKVVRDGKCDGLIMHQNRSCKNMSLLNNEGGQRIQKNLGVPYVIFDGDQTDARNFSEAQFDTRVEALAEMMADKKANEGGNH

SEQ ID NO: 101 - protein, 372 aa, Megasphaera elsdenii
MSQIDELISKLQEVSNHPQKTVLNYKKQGKGLVGMMPYYAPEEIVYAAGYLPVGMFGSQNPQISAARTYLPPFACSLMQADMELQLNGTYDCLDAVIFSVPCDTLRCMSQKWHGKAPVIVFTQPQNRKIRPAVDFLKAEYEHVRTELGRILNVKISDLAIQEAIKVYNENRQVMREFCDVAAQYPQIFTPIKRHDVIKARWFMDKAEHTALVRELIDAVKKEPVQPWNGKKVILSGIMAEPDEFLDIFSEFNIAVVADDLAQESRQFRTDVPSGIDPLEQLAQQWQDFDGCPLALNEDKPRGQMLIDMTKKYNADAVVICMMRFCDPEEFDYPIYKPEFEAAGVRYTVLDLDIESPSLEQLRTRIQAFSEIL

SEQ ID NO: 102 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 103 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 104 - protein, 495 aa, Klebsiella pneumoniae
MNFQHLAYWQEKAKNLAIETRLFINGEYCAAADNTTFETIDPAAQQTLAQVARGKKADVERAVKAARQAFDNGDWSQASPAQRKAILTRFADLMEAHREELALLETLDTGKPIRHSLRDDIPGAARAIRWYAEALDKVYGEVAPTGSNELAMIVREPIGVIAAVVPWNFPLLLACWKLGPALAAGNSVILKPSEKSPLTALRLAGLAKEAGLPDGVLNVVSGFGHEAGQALALHPDVEVITFTGSTRTGKQLLKDAGDSNMKRVWLEAGGKSANIVFADCPDLQQAVRATAGGIFYNQGQVCIAGTRLLLEESIADEFLARLKAEAQHWQPGNPLDPDTTMGMLIDNTHADNVHSFIRGGESQSTLFLDGRKNPWPAAVGPTIFVDVDPASTLSREEIFGPVLVVTRFKSEEEALKLANDSDYGLGAAVWTRDLSRAHRMSRRLKAGSVFVNNYNDGDMTVPFGGYKQSGNGRDKSLHALEKFTELKTIWIALES

SEQ ID NO: 105 - DNA, 1053 bp, Issatchenkia orientalis
atgtcttacgaaatcccacaaacacaaaaggcctgtgtcttttacgaaaacggcggcccaatcacatacaaggacattccagttccaaagccaaaacctactgagattttagtcaaggttctgtactctggtgtctgccacaccgacttgcacgcatggaagggtgactggcctctagctaccaagttgccattggttggtggtcacgaaggtgccggtgttgttgttgccaagggtgaaaacgtcacctcttttgagattggtgattacgcaggtatcaagtggttgaatggttcatgtatgggttgtgaattctgtgaacaaggtgctgaaccaaactgtcctaaggccgacttgagtggttacacccacgacggttccttccaacagtatgctactgctgacgctattcaagctgcacacatctccaaggaaaccgacttggctggtgttgctccaatcttgtgtgcaggtgtcactgtctacaaggctttaaagactgcagaccttagagcaggtgaatgggtttgtatttccggtgcagctggtggtttaggttctcttgctattcaatatgcaaaggctatgggtctgagagttgttggtattgacggtggtgacgaaaagaaggaattgtgtaaatcccttggtgctgaagcatttattgatttcacaaagaccaaggatatcgtcaaggctgtccaagaggcaaccaatggtggtccacatggtgtcatcaatgtctctgtctctgaagctgcaatttctcaatcttgtgaatacgttagacctctaggtaaggttgttcttgttggtttaccagcaggcgcacaagtcaaaactggtgtctttgaagccgttgtcaagtctattgaaattaagggttcttatgtcggtaacagaaaggataccgccgaagcacttgacttctacactagaggcttggtcaagtctccattcaagattgtcggtttatccgaattgccaaaagtctttgaactcatggaacagggtaagattttaggtagaatggtcttagacacctccaaataa

SEQ ID NO: 106 - protein, 350 aa, Issatchenkia orientalis
MSYEIPQTQKACVFYENGGPITYKDIPVPKPKPTEILVKVLYSGVCHTDLHAWKGDWPLATKLPLVGGHEGAGVVVAKGENVTSFEIGDYAGIKWLNGSCMGCEFCEQGAEPNCPKADLSGYTHDGSFQQYATADAIQAAHISKETDLAGVAPILCAGVTVYKALKTADLRAGEWVCISGAAGGLGSLAIQYAKAMGLRVVGIDGGDEKKELCKSLGAEAFIDFTKTKDIVKAVQEATNGGPHGVINVSVSEAAISQSCEYVRPLGKVVLVGLPAGAQVKTGVFEAVVKSIEIKGSYVGNRKDTAEALDFYTRGLVKSPFKIVGLSELPKVFELMEQGKILGRMVLDTSK

SEQ ID NO: 107 - DNA, 1131 bp, Issatchenkia orientalis
atgtttgcatcaaccttcagaagtcaagctgtaagagctgcaagatttactagattccaatccacttttgccattcctgagaagcaaatgggtgttatctttgaaactcatggtggtcctttacaatacaaggaaattccagttccaaaaccaaaaccaactgaaattttaatcaatgttaaatactctggtgtctgccataccgatttacacgcatggaaaggtgactggccattaccagcaaagttacccctagttggtggtcacgaaggtgcgggcattgttgttgcgaaaggttctgcagttaccaactttgagattggcgattatgctggtattaagtggttaaacggttcatgtatgtcatgtgaattctgtgaacaaggtgatgaatctaactgtgaacatgccgatttgagtggttatactcatgatggttctttccaacaatatgccactgctgacgctattcaagctgcaaagatcccaaagggtaccgacttatctgaagttgcgccaattttatgtgctggtgttactgtctataaagctttgaaaactgctgatttaagagcaggtcaatgggttgcgatttctggtgccgctggtggtctaggttctcttgctgtccaatatgcaaaggcaatgggtctaagagttttaggtatcgatggtggtgaaggtaaaaaggaactttttgaacaatgtggtggtgatgtgtttatcgatttcaccagatacccaagagatgcacctgaaaagatggttgctgatattaaggctgcaactaacggtttgggtccacacggtgttatcaatgtctctgtctccccagctgctatctctcaatcatgtgactatgttagagcaactggtaaggttgtccttgtcggtatgccatctggtgctgtctgtaagtctgatgtcttcactcatgttgttaaatccttacaaattaaaggttcttatgttggtaacagagcagataccagagaagctttggaattctttaatgaaggtaaggtcagatctccaatcaaggttgtcccattatctactttacctgaaatttacgaattgatggagcaaggtaagattttaggtagatacgttgttgatacttctaaataa

SEQ ID NO: 108 - protein, 376 aa, Issatchenkia orientalis
MFASTFRSQAVRAARFTRFQSTFAIPEKQMGVIFETHGGPLQYKEIPVPKPKPTEILINVKYSGVCHTDLHAWKGDWPLPAKLPLVGGHEGAGIVVAKGSAVTNFEIGDYAGIKWLNGSCMSCEFCEQGDESNCEHADLSGYTHDGSFQQYATADAIQAAKIPKGTDLSEVAPILCAGVTVYKALKTADLRAGQWVAISGAAGGLGSLAVQYAKAMGLRVLGIDGGEGKKELFEQCGGDVFIDFTRYPRDAPEKMVADIKAATNGLGPHGVINVSVSPAAISQSCDYVRATGKVVLVGMPSGAVCKSDVFTHVVKSLQIKGSYVGNRADTREALEFFNEGKVRSPIKVVPLSTLPEIYELMEQGKILGRYVVDTSK

SEQ ID NO: 109 - DNA, 1134 bp, Issatchenkia orientalis
atgttatccaagaccatcactgctgcattgaggggcaatacaactcgtactgcattcagaatcaatgccattagaagtttagcgatcccagctattccagagacacaaaagggtgttatcttttatgagaacggaggtgaactattttacaaggacattccagttccaaagccaaagccaaatgagattttggtgaatgtcaagtattctggtgtttgtcataccgatttacacgcatggaaaggtgactggcctttggcgaccaagttgccattggttggtggacatgaaggtgccggagttgttgttgctaagggggacaatgtcaccaactttgaaattggcgattatgccggtatcaagtggttgaatggttcatgtatggggtgtgaattttgccaacaaggtgcagagccaaactgtccacaggccgacttgagtggttacacccatgacgggtcctttcaacaatatgccactgccgatgctgttcaggcagccaagattcctcagggcactgatttggctcaagttgcgccaattttatgtgcaggtattactgtctataaggctttaaagactgcagaattaagaccaggtcaatgggttgccatttctggtgctgctggaggtttaggttctcttgctgttcaatatgccaaggccatgggtttgagagttttgggtattgatggtggtgaggagaagggcaagtttgcaaagtctcttggagctgaagttttcattgatttcaccaaatccaaggacattgtcaaggatatccaagaggccaccaatggtggtccacatggtgtcattaatgtttctgtttctccagctgctatttctcaaagtacccagtatgtcagaaccttgggtaaggttgtccttgttggattaccagcgcatgctgtatgcgagtcttcggttttcgaccatgttgtcaagtcgattcaaattagaggctcttatgttggtaacagggaagatactagtgaggctattgattttttcaccaggggtttagtgaagtcaccaattaagattgttggtttgagtgagttgccaaagatctatgaattgatggagcaaggtaagattttaggcagatatgttgttgacacttcgaaatga

SEQ ID NO: 110 - protein, 377 aa, Issatchenkia orientalis
MLSKTITAALRGNTTRTAFRINAIRSLAIPAIPETQKGVIFYENGGELFYKDIPVPKPKPNEILVNVKYSGVCHTDLHAWKGDWPLATKLPLVGGHEGAGVVVAKGDNVTNFEIGDYAGIKWLNGSCMGCEFCQQGAEPNCPQADLSGYTHDGSFQQYATADAVQAAKIPQGTDLAQVAPILCAGITVYKALKTAELRPGQWVAISGAAGGLGSLAVQYAKAMGLRVLGIDGGEEKGKFAKSLGAEVFIDFTKSKDIVKDIQEATNGGPHGVINVSVSPAAISQSTQYVRTLGKVVLVGLPAHAVCESSVFDHVVKSIQIRGSYVGNREDTSEAIDFFTRGLVKSPIKIVGLSELPKIYELMEQGKILGRYVVDTSK

SEQ ID NO: 111 - DNA, 1347 bp, Issatchenkia orientalis
atgtctccttcacaaattaacgttgacaacttatctaattggactgaagaattcaaatctgacgccaagactcaaatcgggggttctgtattgcaacattccaacattgatgaggtcttgattaacagagatgcagaaatcgccaacaagcatatcttcaaccacaagattgaaattgaaggtctacctgtcatggatcagaaggcttctggtagatgttggttgtttgcatcgactaacttgatgcgtgttactgcaatgaagaaatacaatttgaaggaaatcaagctttccccatcgtatttgtttttctatgacaaattggaaagagcaaactatttccttgaacaaatcatcgacactcataaggaaccaatcgattcaagattggttcaatatttcctgaccaatccagttgaagatggtggtcaattcaccatgatggcacaaattgctaccaaatacggtgttgttcctgatcaagtctacccagattctttcaacacaaccacttcgaggattatgaacagattagtcaaccacagattacgttcttatgcaatgactttacgtaacgctctagatgaaggtaaagatgtaatgtccttgaagaatgagatgcaaaaagaaatttatcgtttgctaacaatgttccttggtaacccaccaaagccaaacgaagagtttgtctgggaattcaccgataaagatggtaaatatgaatctattaaaactacaccattaaaatatgcaactgaagttttggatttccatgctccagaatatgtttccttgttaaatgacccaagaaataagtataacaagatggttcaagttgaaagattaggtaatgttgctggtggcgaaccagttgcatacttaaacttagaaattgaaaagttatctcaagctgttgttaacagaatcaaaaataacaaaccagttttctttggtaccgatacacctaaatttatggataaaagtagaggtattatggatatcaatttatgggactatgagttattaggttatgatgtccgtaccatgtcaaagaaggaaagagttgtttttggtgattctttaatgacccacgctatgttgattactgcagtgcacgttgatgaaaatggcaaacctgtcagatacagagtcgaaaacagttggggtaccaagagtggtcaagaaggttattacacaatgacccaagaatattttgaagagtacgtttatcaagtagtcattgaaaagagtgaatttgctgccctaaacctcgatgtttccattctggaggataaagaaccagtcgtcttgccaccttatgaccctatgggtgcacttgctttataa

SEQ ID NO: 112 - protein, 448 aa, Issatchenkia orientalis
MSPSQINVDNLSNWTEEFKSDAKTQIGGSVLQHSNIDEVLINRDAEIANKHIFNHKIEIEGLPVMDQKASGRCWLFASTNLMRVTAMKKYNLKEIKLSPSYLFFYDKLERANYFLEQIIDTHKEPIDSRLVQYFLTNPVEDGGQFTMMAQIATKYGVVPDQVYPDSFNTTTSRIMNRLVNHRLRSYAMTLRNALDEGKDVMSLKNEMQKEIYRLLTMFLGNPPKPNEEFVWEFTDKDGKYESIKTTPLKYATEVLDFHAPEYVSLLNDPRNKYNKMVQVERLGNVAGGEPVAYLNLEIEKLSQAVVNRIKNNKPVFFGTDTPKFMDKSRGIMDINLWDYELLGYDVRTMSKKERVVFGDSLMTHAMLITAVHVDENGKPVRYRVENSWGTKSGQEGYYTMTQEYFEEYVYQVVIEKSEFAALNLDVSILEDKEPVVLPPYDPMGALAL

SEQ ID NO: 113 - DNA, 1737 bp, Issatchenkia orientalis
atgttactcagatcactaaactcttctgctcgttgtgtcaaacaaacaaccagaacaaaggttaggtatctcagccacgtcagtggtgcaagcatggcgaaacctacattgaagaacaactcgagagaatccaacaaatccagaaactatctaattgctgctgtgacagcattggctgtatcaacctcaattggagttgccgtacatgtgaaggaccccttgtataacgatgctaccggcagtgattctccgagaagtatatctgttgacgagtttgtcaagcataattcacaaaacgactgttggattgcaatcaatggcaaggtttatgatttcactgattttattccaaaccatccaggtggggtacctccattagttaatcatgctggttatgatggtactaaactttatgagaaattgcatccaaaaggtacaattgagaaattcttgccaaaggataagtttctgggtgtgttagatggtgaagcgccaaaattggaagcagactatttggtggacgatgatgaacaagagagactggattatttgaacaacttacctcctttgtcatctattcagaatgtttatgatttcgaatacttggccaagaagattttacctaaagatgcctgggcatattattcttgtggtgccgatgatgaaatcacaatgagagaaaaccattatgcttatcaaagagtttatttcagaccaagaatttgtgttgatgtcaaggaagttgatacttcttatgaaatgttaggcactaaaacctctgttcctttttatgtatctgccaccgctttggctaaattaggccatcctgatggtgaatgctcaattgctagaggcgctggtaaggaaggtgtcgttcaaatgatttcgaccctttcctcaatgtcattagatgaaattgccgctgctagaattccaggtgcaacccaatggttccaattatacattaatgaggatagaaatgtcgctaaaggtctggtcaaacatgcagaagacttgggtatgaaggctatctttataactgttgatgctccttctctaggtaacagagaaaaggataaaagattaaagtttgttaatgacaccgatgtcgatttgggtgattccgcagatcgaaacagtggtgcttcaaaggcactatcttcgttcattgatgcttctgtctcttggaatgacgtcaaagcggtcaagtcgtggactaaattgcctgtcttagttaaaggtgttcaaacagttgaagacgttattgaagcttacgatgctggttgtcaaggtgttgttttgtcaaaccacggtggtaggcaactagatactgctcctcctccaatcgaattattagctgaaactgttccaactttgaagagattgggtaaattaagaccagattttgaaattttaattgacggtggtgtcaaaagaggtaccgatattttgaaagcagtcgcaatcggtggccaagatgtcagagtttcagttggtatgggtagacctttcttatatgccaactcttgctatggtgaagcaggtgttagaaaattaattcaaaatctaaaggatgaattagaaatggatatgagattgttgggtgtcactaaaatggaccagctatcttcgaaacatgtcgatactaaacgtttgattggtagagatgcgatcaactatttgtatgataatgtatacagcccaatcgaaaccgttaaattcaacaatgaagattga

SEQ ID NO: 114 - protein, 578 aa, Issatchenkia orientalis
MLLRSLNSSARCVKQTTRTKVRYLSHVSGASMAKPTLKNNSRESNKSRNYLIAAVTALAVSTSIGVAVHVKDPLYNDATGSDSPRSISVDEFVKHNSQNDCWIAINGKVYDFTDFIPNHPGGVPPLVNHAGYDGTKLYEKLHPKGTIEKFLPKDKFLGVLDGEAPKLEADYLVDDDEQERLDYLNNLPPLSSIQNVYDFEYLAKKILPKDAWAYYSCGADDEITMRENHYAYQRVYFRPRICVDVKEVDTSYEMLGTKTSVPFYVSATALAKLGHPDGECSIARGAGKEGVVQMISTLSSMSLDEIAAARIPGATQWFQLYINEDRNVAKGLVKHAEDLGMKAIFITVDAPSLGNREKDKRLKFVNDTDVDLGDSADRNSGASKALSSFIDASVSWNDVKAVKSWTKLPVLVKGVQTVEDVIEAYDAGCQGVVLSNHGGRQLDTAPPPIELLAETVPTLKRLGKLRPDFEILIDGGVKRGTDILKAVAIGGQDVRVSVGMGRPFLYANSCYGEAGVRKLIQNLKDELEMDMRLLGVTKMDQLSSKHVDTKRLIGRDAINYLYDNVYSPIETVKFNNED

SEQ ID NO: 115 - DNA, 1698 bp, Issatchenkia orientalis
  misc_feature (941)..(941): N= A, C, T, or G
  misc_feature (943)..(943): N= A, C, T, or G
atgttaagatcccagttcaaaaacattttgaaaaatgttaacaagaaccattctctaaggagaacttttacttccagcacctcaaaggctggaaaaaatgcttcatacaatgccaagattatatctgcaaccgtggcctcgattgttgcagcagctggctcttatatgttggtccagccttcactagctaatgatgaggcacagtctgctaatccaactaggaagatctctgttgacgaatttgttaaacacaaccatgccgatgattgttggatcactgttaacggtaacgtctatgacttgactgatttcatttcaatgcatccaggtggtactaccccattgattcaaaatgcaggtcacgacgcaactgaaatttacaacaagattcatccaaagggtacaatcgagaacttcttaccaaaggaaaagcaattgggtgttttggatggtgaagctcctaaaatcgaagttgtgcttgacgaaaaggagaaacacagattggagttgttgaatcatctccctgctctttccagaattcaaaacatttatgatttcgaacatattgcttctagagttttgagcgaccaagcatggaactactattcatgtggtgccgaagatgaaatcaccttgagggaaaatcattatgcttaccaaagaatctactttaagccaaaatgttgtgtcaatgttgcagaagttgatacctctcatgaaattttaggtacaaaagcttctgttcctttctacgtttccgcagccgcttctgcaaagttggggcacgaggatggtgaatgttccattgctagaggtgcaggtaaggaaggcgttattcaaatgatttcttccttctcttccaactctttggaggaaattgcagaatccagaattcctggtgcaacacaatggtttcaattatacgttaatgaagacaaggntnttgtgaagaagactttaaaaagggccgaaaacttgggtatgaaggccatctttgtcactgtggacgctgctagtagaggtaatagagaaaaagacattacaatgagaattaccgaagatacagatgagttaatagacgattcttctgttagagctggttctacctctggtgcattgccagctttcattgacaagaggctgacttgggatgaagttaaggatatcatttcatggaccaagttaccagttttgctgaagggtgttcaaagaactgatgatattgagaaggcaattgatattggttgtaagggtgttgtcttgtccaatcatggtggtagacaattagatacttctcctcctccaatagaagttatggctgaatctgttccaatcctaaagcaaaagggtaaactggatccaaatttcagtattttcgttgatggtggtgttagaagaggtacagatattttgaaagctttggctattggtggcagagactgtaaagttgctgttggtctgggtagacctttcctttatgcaaatactggttatggtgaaaagggtgtcagaaaggccgtgcaaattctaagagaagaattaaaggctgacatgagaatgttgggcgttacctctttgaacgagctagacgactcttacattgacaccagaagattactaggtagagatgctgttaaccacatatacaacaacaactactacccaatgtctaagattcaattcaaaaacgaaaaataa

SEQ ID NO: 116 - protein, 565 aa, Issatchenkia orientalis
  MISC_FEATURE (314)..(314): Xaa = Asp, Gly, Ala, or Val
  MISC_FEATURE (315)..(315): Xaa = Ile, Val, Leu, or Phe
MLRSQFKNILKNVNKNHSLRRTFTSSTSKAGKNASYNAKIISATVASIVAAAGSYMLVQPSLANDEAQSANPTRKISVDEFVKHNHADDCWITVNGNVYDLTDFISMHPGGTTPLIQNAGHDATEIYNKIHPKGTIENFLPKEKQLGVLDGEAPKIEVVLDEKEKHRLELLNHLPALSRIQNIYDFEHIASRVLSDQAWNYYSCGAEDEITLRENHYAYQRIYFKPKCCVNVAEVDTSHEILGTKASVPFYVSAAASAKLGHEDGECSIARGAGKEGVIQMISSFSSNSLEEIAESRIPGATQWFQLYVNEDKXXVKKTLKRAENLGMKAIFVTVDAASRGNREKDITMRITEDTDELIDDSSVRAGSTSGALPAFIDKRLTWDEVKDIISWTKLPVLLKGVQRTDDIEKAIDIGCKGVVLSNHGGRQLDTSPPPIEVMAESVPILKQKGKLDPNFSIFVDGGVRRGTDILKALAIGGRDCKVAVGLGRPFLYANTGYGEKGVRKAVQILREELKADMRMLGVTSLNELDDSYIDTRRLLGRDAVNHIYNNNYYPMSKIQFKNEK

SEQ ID NO: 117 - DNA, 1167 bp, Issatchenkia orientalis
atggtgtcccctgctgaaagattatctactattgcgtccacaatcaagccaaacagaaaagattctacatcattacaaccagaagactatccggaacatccgttcaaggtgacggttgttggttccggtaactgggggtgtacaattgccaaggttatagcggaaaacaccgttgagagacctcgtcaatttcaaagagatgttaatatgtgggtctatgaagaattgattgaaggcgaaaagttgactgaaatcataaataccaaacacgaaaacgtcaagtacttgccaggtatcaagttgccagttaacgttgttgcagttccagacattgttgaggcttgtgcaggctcagacttgattgtctttaatattcctcaccaatttttaccaagaattttatcccaattaaagggtaaggtgaatccaaaggctagagcaatttcttgtttgaaaggtttggatgtcaatcctaatggatgtaagttgctctccactgttattactgaagagttgggtatttattgtggtgccttatcaggtgctaatttagctcctgaagttgcacaatgtaaatggtcggaaacaactgttgcatatacaattccggacgatttcagaggtaaaggcaaggatattgaccatcaaattctaaagagtttgttccatagaccttatttccatgttcgtgttattagtgatgttgcaggtatttccattgccggtgcactcaagaatgtcgttgctatggctgctggatttgtcgaaggtttaggttggggtgataatgcaaaggctgcagtcatgagaataggtttggtggaaaccattcaatttgccaagacttttttcgatggctgtcatgctgcaacctttactcatgaatctgcaggtgttgccgacctaatcactacctgtgccggcggccgtaacgttagagttggtagatatatggcacaacattctgtctctgcaacggaggctgaagaaaagttgttgaatggccaatcctgtcaaggtatccacacaactagggaagtttacgagttcctctccaacatgggcaggacagatgagttcccactatttaccaccacctaccgtatcatctacgaaaacttcccaattgagaagctgccagaatgccttgaacctgtggaagattaa

SEQ ID NO: 118 - protein, 388 aa, Issatchenkia orientalis
MVSPAERLSTIASTIKPNRKDSTSLQPEDYPEHPFKVTVVGSGNWGCTIAKVIAENTVERPRQFQRDVNMWVYEELIEGEKLTEIINTKHENVKYLPGIKLPVNVVAVPDIVEACAGSDLIVFNIPHQFLPRILSQLKGKVNPKARAISCLKGLDVNPNGCKLLSTVITEELGIYCGALSGANLAPEVAQCKWSETTVAYTIPDDFRGKGKDIDHQILKSLFHRPYFHVRVISDVAGISIAGALKNVVAMAAGFVEGLGWGDNAKAAVMRIGLVETIQFAKTFFDGCHAATFTHESAGVADLITTCAGGRNVRVGRYMAQHSVSATEAEEKLLNGQSCQGIHTTREVYEFLSNMGRTDEFPLFTTTYRIIYENFPIEKLPECLEPVED

SEQ ID NO: 119 - DNA, 1566 bp, Issatchenkia orientalis
atgttgtccctctctaaacagtcaagaaactttttcaaattgaactatttttcagtcacccaaatagcaaaaatgtctgcaacttccgtcactttcccaattatcaacgaaacttaccaacagccaaccgggcttttcatcaacaatgaatttgttagtgcaaagtcaggtaagacttttgatgttaacaccccaattgatgagtctctcatttgtaaagtccaacaggccgatgctgaagatgttgaaattgccgttcaagcagcatctaaagcttacaagacttggagatttacaccgccaaatgaaagaggcagatacttgaacaaattggccgatttgatggacgaaaagagagacttacttgccaaaattgaatcccttgataatggtaaggccttacattgtgcaaaattcgatgtcaatcttgtcattgaatatttcagatactgtgcaggttactgtgataaaatcgatggtagaacaattacaaccgatgtagaacattttacctacactagaaaggaacctttaggtgtctgtggtgcaattacaccttggaacttcccattgctgatgtttgcttggaaaatcggcccggctttagcaaccggtaataccattatcttgaagcctgccagtgcaacacctctatcaaacctctttacttgtaccttgatcaaggaggcgggcattccagccggtgttgttaatgttgttccaggttccggtagaggctgtggtaactccattttacaacatcctaaaattaagaaggttgcgtttaccggatctacagaagttggtaaaactgttatgaaggaatgtgctaattccatcaaaaaggttactctcgaattgggtggtaagtctccaaacattgttttcaaagactgtaacgttgaacaaaccattcaaaatttgattactggtattttcttcaatggtggtgaagtctgttgtgctggttctagaatttacattgaagcaaccgatgagaaatggtatactgaattcttgaccaaattcaaggagactgttgaaaaattaaagattggtaacccatttgaagagggtgttttccaaggtgcacaaaccactccagatcaattccaaactgtcttggactacatcaccgctgctaacgaatccagcttgaaactattaactggtggtaaaagaattggcaataagggatactttgttgagccaactatcttctacgatgttcctcaaaattccaagttaactcaagaagaaatctttggtccagttgctgttgttttacctttcaagtccactgaagaattgattgaaaaggcaaatgattccgattttggcttaggttccggtattcacactgaagatttcaacaaggcaatttgggtttccgaaaggcttgaagcaggttctgtttggatcaacacttacaatgatttccacccagctgctccattcggtggttacaaggaatccggtattggcagagaaatgggtattgaagctttcgacaactatactcaaaccaagttagttagagctagagttaacaagccagctttttag

SEQ ID NO: 120 - protein, 521 aa, Issatchenkia orientalis
MLSLSKQSRNFFKLNYFSVTQIAKMSATSVTFPIINETYQQPTGLFINNEFVSAKSGKTFDVNTPIDESLICKVQQADAEDVEIAVQAASKAYKTWRFTPPNERGRYLNKLADLMDEKRDLLAKIESLDNGKALHCAKFDVNLVIEYFRYCAGYCDKIDGRTITTDVEHFTYTRKEPLGVCGAITPWNFPLLMFAWKIGPALATGNTIILKPASATPLSNLFTCTLIKEAGIPAGVVNVVPGSGRGCGNSILQHPKIKKVAFTGSTEVGKTVMKECANSIKKVTLELGGKSPNIVFKDCNVEQTIQNLITGIFFNGGEVCCAGSRIYIEATDEKWYTEFLTKFKETVEKLKIGNPFEEGVFQGAQTTPDQFQTVLDYITAANESSLKLLTGGKRIGNKGYFVEPTIFYDVPQNSKLTQEEIFGPVAVVLPFKSTEELIEKANDSDFGLGSGIHTEDFNKAIWVSERLEAGSVWINTYNDFHPAAPFGGYKESGIGREMGIEAFDNYTQTKLVRARVNKPAF

SEQ ID NO: 121 - DNA, 1506 bp, Issatchenkia orientalis
atgtcagcactgttcagaaccattgagactccaaacggtaaaaccctggaacaaccactgggtctcttcatcgacaatgagtgggtgaaaacaaaccgtacttttgagaccattaatccgtccacaggtgaggcgatctgtcatgtttaccgtgctggggtccaggaggtgaacgacgctgtcgaagctgcaaatagagcatttagaaacgaatcttggtcaggtctaactggttctcaacgtggcgatttactgtatcgcatgtaccaagttatcaaaagagacgccgagagcattgcatcgattgagtccatggataatggtaaaccgtatgctgcagaatgcctagatggagatttaggtgaagctgctgacgttttcaaatattatgccggttgggccgacaagatcaccggtgaactcattggctcgagtgtattgggtaagaataagatgtgttatgtcgagcctacaccactgggtgccgttggcggtatagtcccttggaatttcccgtttaccatgatggcatggaaaattgccccggcactggcgacgggttgtacagtggttatgaagtcaagtgaagtcacaccgttgacggcattatggtatggcaagattgcacttgaagtgggtctacctaaaggtgtacttaacatcctctccggttttggatcggatgttggatcggccatggcttcacatccaaagttggctaagatagcgttcactggctcaactgcaactggtaaaaaaatcatggaagcagcaggtggttccaacttgaaaaaggttacactagagtgtggtggtaaatctccttacattgtttttgatgatgctgacttagaattggcagtagaatgggcatattggggtatttggtataacaaaggtgaggtttgtacttcaacttcgagatttttgattcaggaagacatttacgataagtttgttgagagttttgttgagttgaccaagacgagagcaatcactgctgatccgtttgatgatagatgcactatcgggcctttggtttctagctcacagtacgaaaaagtcaaaaagtacgttgaaataggtaaaaatgaaggagcaaagctactaactggcaaattcatcgacgggccaggctatttctgtgagccatttatcttcagtgaatgcactgacgatatgacaatcatgaaagaggaaatctttggccctgttgtggggattactaaattctcaacggttaaagaggcgatcgagagagccaatgctacgacttacggtttaggagctgcgttgttttcctctaacataacaaaggcacattctgtggctgccaagttggaggctggaatggtgtggatcaattctaatggtgattctgatatccacattccatttggtggttccaaaatgagtggtataggtagggagttggggccatacgcactagacttgtttactgagaaaaaggcagttcatgtcaacttatcgcttccggtcaagtga

SEQ ID NO: 122 - protein, 501 aa, Issatchenkia orientalis
MSALFRTIETPNGKTLEQPLGLFIDNEWVKTNRTFETINPSTGEAICHVYRAGVQEVNDAVEAANRAFRNESWSGLTGSQRGDLLYRMYQVIKRDAESIASIESMDNGKPYAAECLDGDLGEAADVFKYYAGWADKITGELIGSSVLGKNKMCYVEPTPLGAVGGIVPWNFPFTMMAWKIAPALATGCTVVMKSSEVTPLTALWYGKIALEVGLPKGVLNILSGFGSDVGSAMASHPKLAKIAFTGSTATGKKIMEAAGGSNLKKVTLECGGKSPYIVFDDADLELAVEWAYWGIWYNKGEVCTSTSRFLIQEDIYDKFVESFVELTKTRAITADPFDDRCTIGPLVSSSQYEKVKKYVEIGKNEGAKLLTGKFIDGPGYFCEPFIFSECTDDMTIMKEEIFGPVVGITKFSTVKEAIERANATTYGLGAALFSSNITKAHSVAAKLEAGMVWINSNGDSDIHIPFGGSKMSGIGRELGPYALDLFTEKKAVHVNLSLPVK

SEQ ID NO: 123 - DNA, 1506 bp, Issatchenkia orientalis
atggctcttccacttgcaactacaatctccttatcaagcggcaaaacattagaacagccaattggtttatttattgataatgaatttgtcaatccaatttctgtttctaatgcaagaacactaacaaccttcaacccaagcacaggtgagccaataaccgatgttcattgtgcctcagctgcagatgttgatgttgcggtaaatgctgcaaacaaggcaatggaaacatggaaagacattgatcctactgttcgtgtcgaacttttactaaaattggccagcttagttgacgagcattcccaagcaattgctgaaattgaagcactagactcgggtaaaccattgtactcgaatgcactggcggatgttcaatcggttgctgagtacttaaggtactgtgccggttgggcggataaattacacggtacgcaaattccaataaactctaaggtaatggctattacaaaacgtgtacccttagttgtcggctgcatcattccatggaactacccaatttcaatggcctcctggaagttctgtccagcattggctgccggatgtactattgtaatgaagtcaagtgagataaccccgttatcgttactttattttgcgaatttggtcaaattagcaggtttccctaagggtgtttttaatgtcgtctctggatttggtgatgatgttggctcagcgctttcaaatcacccaaagttgggtaagattgcatttacaggctcgaccttgaccgggcaaaaggtgatggcggatgctgccagatcaaatttgaaaagcgtatctttggaatgtggtggtaaatctccacttattgtcttcgaagatgcagaattggatgaatgcgttaaatgggcaagttttggtgtcatgtataacaccggacaaaattgtactgccaattctcgtattattgtgcatgataaggtttatgatcaatttatcgaaaagttcctgtctcaactcaaggaagattggaaaatgggagatgtcatgaatgaaaagactacattgggaccacttgtcagccaacaacaatatgagcgtgttcagtcgtatattgatataggtgtcaaagaaggggctacactgattcaaccgcttaaggagagcactccatcaaatggattctacatctctcctactgtttttactaacgttaaggaagatatgagaattgttaaggaggaaatatttggtcctgtcgtaactatctccaaattctcaactgaggaagaggcaatttcaaaggcgaatgatacaatttatggcttagctgcaatgttatttactactaattttgaacgtgccaacagagttgctgataagctggaagctggcagtgtgtacattaatagctctaacaacgagagtaccaaagttccatttggaggaatgaagatgagtggtattggaagagagttggggcaagaagcatttaatttgtacactgttacaaagagtatttattatagttatggtgctaagctttaa

SEQ ID NO: 124 - protein, 501 aa, Issatchenkia orientalis
MALPLATTISLSSGKTLEQPIGLFIDNEFVNPISVSNARTLTTFNPSTGEPITDVHCASAADVDVAVNAANKAMETWKDIDPTVRVELLLKLASLVDEHSQAIAEIEALDSGKPLYSNALADVQSVAEYLRYCAGWADKLHGTQIPINSKVMAITKRVPLVVGCIIPWNYPISMASWKFCPALAAGCTIVMKSSEITPLSLLYFANLVKLAGFPKGVFNVVSGFGDDVGSALSNHPKLGKIAFTGSTLTGQKVMADAARSNLKSVSLECGGKSPLIVFEDAELDECVKWASFGVMYNTGQNCTANSRIIVHDKVYDQFIEKFLSQLKEDWKMGDVMNEKTTLGPLVSQQQYERVQSYIDIGVKEGATLIQPLKESTPSNGFYISPTVFTNVKEDMRIVKEEIFGPVVTISKFSTEEEAISKANDTIYGLAAMLFTTNFERANRVADKLEAGSVYINSSNNESTKVPFGGMKMSGIGRELGQEAFNLYTVTKSIYYSYGAKL

SEQ ID NO: 125 - DNA, 1544 bp, Issatchenkia orientalis
  misc_feature (1319)..(1319): N= A, C, G, OR T
atgatgggcgcaactacagcaaaaattagtattccaaatggtaacaaatacgagcaacctacaggtttgttcatcaatggtgagtttgttgcttcaagtgatggtaaaactgcagaagttgagaatccaggcaatggaaacattgtatgttctgtccacttagcttctattgaggatattaataccgccgtagaagctgctgaagatgcatttttcaaaaggtgggccaccatcagtggtaaagccaagggagaatacttgagtaagattgccgatctaatcgttaaatattctgatcaattggcagatctagaggctattgaatcaggtaagccaaaggacaccaatgcaatctttgatgttttacattcggctgatgttttcagatactatgctggcaaggctgtcactgcacaaagcggcaagactatcgagtccgaactctccaaatttacatacacagtttacgagccctatggtgtttgtgccgctatcatcgcatggaacttcccaatgagcacatttgcgtggaaagttgcggcatgtttagctgctggtaatacaatggttgtcaaaacttccgagctgactccgttatctgcattgttcatgtgtaagattttccaagaagcagatctacctgctggagttataaacgtcacatgtggtttaggttctgttgcaggtgttcgattgagtgaacatgaaaaggttcagaaaatttcgtttactggctccactggcgttggtaagttgatccaagaatccgcagcaaagtctaacttaaagtattgtacgcttgaatgtggtggtaagtctccgttagtgatttacgaggatgcagatcttgagcaagcagtgaagtgggctgcctttggtatttttttcaacaaaggtgaaatttgcacagcctcttccagaatatatgttcaagaatcagtctatgacaaatttttgactatgtacaaggatcatgtggaagaagcctatgttcaaggagaacagtttgccactggtgttaacgttgggcctactgtctgcaaagcccaacaagagaaaatactggcctacattgaaagtgccaagcaagaaggtggtagaattatcactggtggtaaaataccatcttacacgaacaaaaatggttactatctcgaaccaacaattattgcagattgtaaccaggatatgaaggtagtcagggaagagattttcggaccagtcgttactgtatccaaattcactagtgatgaagaagccatcaaattaagcaatgattccgaatatggcttggcagcatatttattcactystsrasnassrgttyrgytaaaatyrththraaggacctcgttagatctcagaattatatcagaaaagtgcaaagcggacaggtctttgtcaacttcacctttgcggctgatttcaggttgccatttggcggatataagatgagtggtaacggaagagagcttggtgatgaaggactgagtgctttccagcaagtcaaagcagtacacattaatctcactgggaagttgtaa

SEQ ID NO: 126 - protein, 503 aa, Issatchenkia orientalis
MMGATTAKISIPNGNKYEQPTGLFINGEFVASSDGKTAEVENPGNGNIVCSVHLASIEDINTAVEAAEDAFFKRWATISGKAKGEYLSKIADLIVKYSDQLADLEAIESGKPKDTNAIFDVLHSADVFRYYAGKAVTAQSGKTIESELSKFTYTVYEPYGVCAAIIAWNFPMSTFAWKVAACLAAGNTMVVKTSELTPLSALFMCKIFQEADLPAGVINVTCGLGSVAGVRLSEHEKVQKISFTGSTGVGKLIQESAAKSNLKYCTLECGGKSPLVIYEDADLEQAVKWAAFGIFFNKGEICTASSRIYVQESVYDKFLTMYKDHVEEAYVQGEQFATGVNVGPTVCKAQQEKILAYIESAKQEGGRIITGGKIPSYTNKNGYYLEPTIIADCNQDMKVVREEIFGPVVTVSKFTSDEEAIKLSNDSEYGLAAYLFTKDLVRSQNYIRKVQSGQVFVNFTFAADFRLPFGGYKMSGNGRELGDEGLSAFQQVKAVHINLTGKL

SEQ ID NO: 127 - DNA, 1716 bp, Issatchenkia orientalis
  misc_feature (655)..(655): n is a, c, g, or t
atggctccaactgctgttgatatccataacgagtacaaacagaatgtttccaacgaacaggaaattcctttcaacaaaactgaaagaaagtcatcgattgcatctaaattaggactgaatccagacgctaagattcactacaattctgctgttcctatattatacgaagatggtttaaaggaaaaaggtacaaccatttcctcttctggtgcattgattgcattctctggttccaaaacaggtagatctccaaaggacaaaagaattgtcgatgaagagacttcaacagacaacatctggtggggtccagtcaataagaaggttgatgaaaacacttggaatatctcgaaatctagagcgattgattatttgagaacaagagagaaggtttacattatcgatgcttttgctggttgggatccaagatacagaattaaggttagaattgtctgtgctagagcttaccatgctttgttcatgaagaatatgttaattagaccaacaacggaagaattaaagaactttggtgagcctgatttcaccatttggaatgcaggtcaattccctgctaatgtttacactaagggtatgacttcttcaacttctgttgaaataaatttcaagtctthrysgymtthrsrsrthrsrvagtasnhyssratggaaatggttatcctaggtactgaatacgcaggtgaaatgaagaaaggtatctttaccgttatgttctacttgatgccaatcagacacaaggttttaactttacactcttctgcaaatcaaggtaaaaaggatggtgatgtcacattattctttggtttatctggtacaggtaaaacaaccttgtctgcagatcctcatagagaattgattggtgatgatgaacattgctggtctgatcatggtgttttcaacattgaaggtggatgttatgctaagtgtttggacttatctgctgaaagagaacctgagattttcaatgcaattaggtttggatctgtcttggagaatgttgtctatgatccagttgatagaactgttgactattccgctgctaatgtcactgaaaatactagatgtgcttatcctatcgactttattccttctgctaagatcccatgtctggcagattctcatccaaagaatattgttcttttaacttgtgatgcaagaggtgttttgccacctgtctccaagctaactaatgcacaagtcatgtatcactttatctctggttacacctccaagatggcaggtaccgaagttggtgtcactgaaccagaagcaaccttctctgcatgttttggtcaacctttcttagttttacatccaatgaaatacgcacaacaactctctgataaaatggctgaacattcttccaccgcttggttattgaataccggttggactggtcaatcttatgttaaaggtggtaagagatgtccattgaagtatactagagcaattttagatgctattcactctggtgagcttgcaaaacaggaattcgaaacataccctactttcggtttacaagttccaaaaacttgtccaggtgtcccagaaagtgttctgaacccatctaaacactgggctactggtgaagctgatttcaaggctgaagtcactaacttggctaaattatttgctgagaactttgaaaagtattctgcagaatgtactgcagaagttgttgctgctggtcctgctttataa

SEQ ID NO: 128 - protein, 560 aa, Issatchenkia orientalis
MAPTAVDIHNEYKQNVSNEQEIPFNKTERKSSIASKLGLNPDAKIHYNSAVPILYEDGLKEKGTTISSSGALIAFSGSKTGRSPKDKRIVDEETSTDNIWWGPVNKKVDENTWNISKSRAIDYLRTREKVYIIDAFAGWDPRYRIKVRIVCARAYHALFMKNMLIRPTTEELKNFGEPDFTIWNAGQFPANVYTKGMTSSTSVEINFKSMEMVILGTEYAGEMKKGIFTVMFYLMPIRHKVLTLHSSANQGKKDGDVTLFFGLSGTGKTTLSADPHRELIGDDEHCWSDHGVFNIEGGCYAKCLDLSAEREPEIFNAIRFGSVLENVVYDPVDRTVDYSAANVTENTRCAYPIDFIPSAKIPCLADSHPKNIVLLTCDARGVLPPVSKLTNAQVMYHFISGYTSKMAGTEVGVTEPEATFSACFGQPFLVLHPMKYAQQLSDKMAEHSSTAWLLNTGWTGQSYVKGGKRCPLKYTRAILDAIHSGELAKQEFETYPTFGLQVPKTCPGVPESVLNPSKHWATGEADFKAEVTNLAKLFAENFEKYSAECTAEVVAAGPAL

SEQ ID NO: 129 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 130 - DNA, 420 bp, Streptomyces avermitilis
atgttaagaaccatgttcaaatctaagattcacagagcaactgttactcaagcagatctccattatgttggttccgttactattgatgcagacttgttagacgcagcagacttgttgccaggtgaattggttcacatcgttgacattacgaacggtgctagattggaaacttacgtcattgaaggtgaacgtggttccggtgttgttggtatcaatggtgctgccgctcatttagttcatcctggtgatcttgttatcattatctcctatgcacaagtttcagatgcagaagcacgtgcattgcgtccaagagttgttcacgttgacagagacaatagagttgttgcgcttggtgcggatccagccgaaccagtcccaggttccgaccaagctagatccccacaagctgttactgcataa

SEQ ID NO: 131 - DNA, 384 bp, Clostridium acetobutylicum
atgcacttgaacatgttgaagtccaagatccacagagctaccgtcgttcaagcagacttgaactacgtcggttccatcaccatcgacagaaacttgatggacaaggcaaacatcttggaatacgaaaaggtcgagatcgcaaacatcaacaacggtgcaagattcgaaacctacgtcatcgctggtgaggctggttccggtatcatctgtttgaacggtgctgctgcaagatgtgcacaagcgggtgacaaggttatcatcatgtgttactgttccttgaccccagaagaagcttccgagcacagaccaaaggtcgttttcgtcaacgacgacaactccatctccaacgtcaccgaatacgagaagcacggcaccatcggttaa

SEQ ID NO: 132 - DNA, 354 bp, Helicobacter pylori
atgaccttcgagatgttgtactccaagatccacagagcaaccatcaccgacgcaaacttgaactacatcggctccatcaccatcgacgaggacttggctaagttggctaagttgagagagggtatgaaggtcgaaatcgtcgacgtcaacaacggcgagagattctccacctacgtcatcttgggtaagaagagaggtgaaatctgcgtcaacggtgcagcagccagaaaggtcgctatcggtgacgtcgtcatcatcttggcttacgcatccatgaacgaggacgagatcaacgctcacaagccatccatcgtcttggtcgacgaaaagaacgaaatcttggaaaagggttaa

SEQ ID NO: 133 - protein, 117 aa, Helicobacter pylori
MTFEMLYSKIHRATITDANLNYIGSITIDEDLAKLAKLREGMKVEIVDVNNGERFSTYVILGKKRGEICVNGAAARKVAIGDVVIILAYASMNEDEINAHKPSIVLVDEKNEILEKG

SEQ ID NO: 134 - DNA, 387 bp, Bacillus sp. TS25
atgtacagaaccatgatgaagtccaagttgcacagagcgaccgtcaccgaagcaaacttgaactacgtcggttccatcaccatcgaccaagacttgatggaagctgcagacatcttggaaaacgagaaggtccaaatcgtcaacaacaacaacggtgctagattcgaaacctacgtcatcgctggtccaagaggctccggcaccatctgtttgaacggtgcagcagcaagattggtccaaccaggtgacaccgttatcatcatctcctacgcaatgttggaagaagccgaggctagaaagcaccaacctgtcgtcgttttgttgaacccagacaacaccatccaagaattgatcagagaaacccacggtgctaccgctaccgtctaa

SEQ ID NO: 135 - protein, 128 aa, Bacillus sp. TS25
MYRTMMKSKLHRATVTEANLNYVGSITIDQDLMEAADILENEKVQIVNNNNGARFETYVIAGPRGSGTICLNGAAARLVQPGDTVIIISYAMLEEAEARKHQPVVVLLNPDNTIQELIRETHGATATV

SEQ ID NO: 136 - DNA, 411 bp, Corynebacterium glutamicum
atgttgagaaccatcttgggttccaaaatccacagagctaccgttacccaagcagacttggactacgttggttcagtcaccatcgatgcagacttggttcatgccgcaggtttgatcgaaggtgaaaaggttgccatcgtcgacatcaccaatggcgctagattggaaacctacgttatcgttggtgatgctggcaccggtaacatctgtatcaacggtgcagcagcacacttgatcaacccaggtgatttggttatcatcatgtcctacttgcaagctaccgatgcagaggccaaggcttacgaaccaaagatcgttcacgtcgacgcagacaacagaatcgttgctttgggtaacgacttggcagaagctttgcctggttccggtttgttgacctcaagatctatctaa

SEQ ID NO: 137 - protein, 136 aa, Corynebacterium glutamicum
MLRTILGSKIHRATVTQADLDYVGSVTIDADLVHAAGLIEGEKVAIVDITNGARLETYVIVGDAGTGNICINGAAAHLINPGDLVIIMSYLQATDAEAKAYEPKIVHVDADNRIVALGNDLAEALPGSGLLTSRSI

SEQ ID NO: 138 - DNA, 384 bp, Bacillus licheniformis
atgtacagaaccttgatgtccgctaagttgcacagagctagagtcaccgaagcaaacttgaactacgttggttccgtcaccatcgacgaggacttgttggacgcagtcggtatgatggcaaacgaaaaggtccaaatcgtcaacaacaacaacggtgctagattggaaacctacatcatccctggtgagagaggttccggtgtcgtctgtttgaacggtgctgcagctagattggtccaagttggtgacgtcgttatcatcgtttcctacgccatgatgtccgaagaagaagcaaagacccacaagccaaaggtcgctgttttgaacgaaagaaacgaaatcgaagagatgttgggtcaagaaccagctagaaccatcttgtaa

SEQ ID NO: 139 - protein, 127 aa, Bacillus licheniformis
MYRTLMSAKLHRARVTEANLNYVGSVTIDEDLLDAVGMMANEKVQIVNNNNGARLETYIIPGERGSGVVCLNGAAARLVQVGDVVIIVSYAMMSEEEAKTHKPKVAVLNERNEIEEMLGQEPARTIL

SEQ ID NO: 140 - DNA, 1356 bp, Streptomyces avermitilis
atgacaccacagccaaacccacaagtcggtgcagcagtcaaagctgcagatagagcacacgtcttccactcttggtctgcacaagaattgatcgatccattggctgttgctggtgcagagggttcctacttctgggattacgatggtagacgttaccttgacttcacctccggcttagtcttcaccaacatcggttaccaacacccaaaggttgtcgcagctatccaagaacaagccgcatctttgactacatttgccccagctttcgcagttgaagcaagatccgaagctgcaagattgatcgctgagcgtactccaggtgatttagacaaaatcttcttcaccaacggtggcgcagatgctatcgagcacgctgttcgtatggcaagaatccacgctggtagaccaaaggtcttatccgcatacagatcataccacggtggtacacaacaggcagtcaacatcactggtgatccaaggagatgggcatccgattccgcttctgctggcgttgtccacttctgggctccatacttatacagatccagattctacgccgaaactgagcaacaagaatgtgagcgtgctcttgagcacttggaaactactatcgccttcgaaggtccaggtactattgccgctatcgttttggaaactgtcccaggtactgctggtatcatggttcctccaccaggttacttagcaggtgttagagaattgtgtgacaaatacggtatcgtcttcgtcttggatgaagtcatggctggtttcggcagaactggcgaatggttcgctgcagacttattcgatgttaccccagacttgatgaccttcgctaagggtgtcaactcaggttacgttccattgggtggtgttgctatctccggcaaaatcgcagagactttcggtaagagagcttacccaggtggtttgacgtactccggtcaccctcttgcttgcgcagccgctgttgctactatcaacgttatggcagaagaaggtgtcgttgaaaacgctgcaaacttgggtgctagagttatcgaaccaggtttgagagaacttgcagagagacacccatcagttggtgaagttagaggtgttggtatgttctgggctttggaattggttaaggatagagaaaccagagaacctttggtcccatacaatgccgctggtgaagcgaacgcaccaatggctgctttcggtgcagctgcaaaggcaaacggtttgtggccattcatcaacatgaacagaacccacgttgttcctccttgtaacgttaccgaagccgaagctaaagaaggcttggcagcattggatgcagctttatctgttgcagatgagtacactgtctaa

SEQ ID NO: 141 - DNA, 1416 bp, Saccharomyces cerevisiae
atgtccatctgtgagcaatactacccagaagaaccaaccaagccaaccgtcaagaccgaatccatccctggtccagaatcccaaaagcaattgaaggaattgggtgaagttttcgacaccagaccagcttacttcttggcagactacgaaaagtccttgggtaactacatcaccgacgtcgacggtaacacctacttggacttgtacgctcaaatctcctccatcgccttgggttacaacaacccagcattgatcaaagccgctcaatccccagaaatgatcagagcattggttgacagaccagccttgggtaacttcccttccaaggacttggacaagatcttgaagcaaatcttgaagtccgctccaaagggtcaggaccacgtctggtccggtttgtccggtgcagacgcaaacgaattggctttcaaggctgcattcatctactacagagctaagcaaagaggttacgacgcagacttctccgaaaaggaaaacttgtccgttatggacaacgacgcaccaggtgctccacacttggcagttttgtccttcaagagagctttccacggtagattgttcgcatccggttccactacctgttccaagccaatccacaagttggacttccctgctttccactggccacacgccgaatacccatcctaccagtaccctttggacgaaaactccgacgcaaacagaaaggaggacgaccactgcttggcaatcgttgaagaattgatcaagacctggtccatccctgttgctgcgttgatcatcgaaccaatccaatccgagggtggtgacaaccacgcctccaagtacttcttgcaaaagttgagagacatcaccttgaagtacaacgtcgtctacatcatcgacgaagtccaaactggcgttggcgcaaccggtaagttgtggtgtcacgaatacgcagacatccagcctccagtcgacttggtcaccttctccaagaagttccaatccgctggctacttcttccacgaccctaagttcatcccaaacaagccatacagacaattcaacacctggtgtggtgaaccagcaagaatgatcatcgcaggtgcaatcggtcaagagatctccgacaagaagttgaccgaacaatgctccagagtcggtgactacttgttcaagaagttggaaggtttgcaaaagaagtacccagagaacttccaaaacttgagaggtaagggtagaggcaccttcatcgcttgggacttgccaactggcgagaagagagacttgttgttgaagaagttgaagttgaacggctgtaacgttggtggctgtgctgttcacgcagtcagattgagaccttccttgaccttcgaagagaagcacgcagacatcttcatcgaagctttggctaagtccgtcaacgaattgtaa

SEQ ID NO: 142 - DNA, 1428 bp, Saccharomyces kluyveri
atgccatcctactccgttgcagaattgtactacccagacgaacctaccgaacctaagatctccacctcctcctacccaggtccaaaggcaaagcaagaattggaaaagttgtccaacgtcttcgacaccagagcagcttacttgttggcagactactacaagtcccgtggtaactacatcgttgaccaggacggtaacgtcttgttggacgtttacgctcaaatctcctccatcgccttgggttacaacaacccagaaatcttgaaggttgcaaagtccgacgcaatgtccgttgcattggccaaccgtccagcattggcttgtttcccatccaacgactacggtcaattgttggaagacggtttgttgaaggcagcaccacaaggtcaagacaagatctggaccgctttgtccggttccgacgcaaacgaaaccgccttcaaagcctgcttcatgtaccaagctgcgaagaagagaaacggtagatccttctccaccgaagaattggaatccgttatggacaaccaattgccaggcacctccgaaatggttatctgttccttcgaaaagggtttccacggtcgtttgttcggttccttgtccactaccagatccaagcctatccacaagttggacatcccagctttcaactggcctaaagccccattcccagacttgaagtacccattggaagaaaacaaggaagccaacaaggctgaagaatcctcctgtatcgaaaagttctcccaaatcgttcaagagtggcaaggtaagatcgctgcagttatcatcgaaccaatccagtccgagggtggcgacaaccacgcttcctccgacttcttccaaaagttgagagaaatcaccatcgaaaacggtatcttgatgatcgtcgacgaagttcaaaccggtgtcggtgctaccggcaagatgtgggcacacgaacactggaacttgtccaaccctccagacttggttaccttctccaagaagttccaagcagcaggtttctactaccacgacccaaagttgcaaccagaccagccattcagacagttcaacacctggtgtggtgacccatccaaggctttgatcgccaaggttatctacgaagaaatcgttaagcacgacttggtcaccagaactgccgaagtcggtaactacttgttcaacagattggaaaagttgttcgaaggtaagaactacatccagaacttgagaggtaagggtcaaggcacctacatcgctttcgacttcggcacctcctccgagagagactccttcttgtccagattgagatgtaacggtgcaaacgtcgctggttgcggtgactccgctgtcagattgagaccatccttgaccttcgaagagaagcacgcagacgtcttggtttccatcttcgacaagaccttgagacaattgtacggctaa

SEQ ID NO: 143 - DNA, 747 bp, Escherichia coli
atgatcgttttggtcaccggtgcaaccgcaggtttcggcgaatgtatcaccagaagattcatccagcagggtcacaaggttatcgctaccggtagaagacaagagagattgcaagaattgaaggacgagttgggtgacaacttgtacatcgctcaattggacgttagaaacagagcagctatcgaagaaatgttggcatccttgccagctgaatggtgcaacatcgacatcttggtcaacaacgctggtttggcattgggtatggaaccagctcacaaggctagtgttgaggactgggagaccatgatcgacaccaacaacaagggtttggtctacatgaccagagcagttttgcctggtatggttgaaagaaaccacggtcacatcatcaacatcggttccaccgctggttcctggccatacgctggcggtaacgtctacggtgctaccaaggctttcgttagacagttctccttgaacttgagaaccgacttgcacggcaccgctgttagagttaccgacatcgaaccaggtttggttggtggcaccgaattctccaacgtcagattcaagggcgacgacggtaaggctgaaaagacctaccaaaacaccgtcgctttgaccccagaagacgtttcagaggctgtttggtgggtcagtaccttgccagcacacgtcaacatcaacaccttggaaatgatgccagtcacccaatcctacgcaggtttgaacgttcacagacaataa

SEQ ID NO: 144 - DNA, 804 bp, Saccharomyces cerevisiae
atgtcccaaggtagaaaggcagcagaaagattggcaaagaagaccgtcttgatcaccggtgcgtccgctggtatcggtaaggctaccgcgttggagtacttggaagcatccaacggtgacatgaagttgatcttggcagcaagaagattggagaagttggaagaattgaagaagaccatcgaccaagaattcccaaacgctaaggtccacgttgcacaattggacatcacccaagcagagaagatcaagccattcatcgaaaacttgccacaagaattcaaggacatcgacatcttggtcaacaacgctggtaaggcgttgggttccgacagagttggtcaaatcgcaaccgaagacatccaagacgtcttcgacaccaacgtcaccgctttgatcaacatcacccaagctgttttgccaatcttccaagcgaagaactccggtgacatcgtcaacttgggttccatcgctggtagagacgcatacccaaccggctccatctactgcgcctccaagttcgctgtcggtgctttcaccgactccttgagaaaggaattgatcaacaccaagatcagagtcatcttgattgcccctggtttggtcgaaaccgaattctccttggttagatacagaggtaacgaagaacaagcaaagaacgtttacaaggacactaccccattgatggccgacgacgttgcagacttgatcgtttacgctacctccagaaagcaaaacaccgttatcgcagacaccttgatcttcccaaccaaccaagcatccccacaccacatcttcagaggttaa

SEQ ID NO: 145 - DNA, 420 bp, Streptomyces avermitilis
atgcttagaaccatgttcaaatccaagatccacagagcaaccgtcactcaagcagatttgcattacgttggttctgttactattgacgcagacttacttgatgcagccgatttacttcctggtgagcttgttcatattgttgatatcaccaatggtgcgcgtcttgaaacctatgtcattgagggtgaacgtggttccggtgtcgtcggtatcaatggcgcagctgcacacctcgtccatccaggtgacctggtcatcatcatttcttatgcacaggtctccgatgctgaagcccgtgccttaagaccaagagtcgttcacgtcgacagagataacagagttgtcgctttaggtgcagacccagcagagccagttccaggttccgatcaagctagatcaccacaggctgttaccgcctaa

SEQ ID NO: 146 - DNA, 420 bp, Streptomyces avermitilis
atgttaagaactatgtttaagtccaagattcacagagctaccgtcacccaagcagatttgcattacgtcggttccgttaccattgatgcagatttactcgatgcggcagacttgttacctggtgaactagttcacattgttgacattaccaatggtgctagattggaaacttacgtcattgaaggtgaaagaggtagtggtgtcgttggtatcaatggtgcagctgctcacttagttcacccaggtgacttagtcatcatcatttcatatgcacaagtttccgatgcggaagctagagcattaagaccaagagttgttcatgttgatagagacaacagagtcgttgcacttggtgcagatcctgctgaaccagttccaggttcagatcaagctaggtctccacaagcagttactgcataa

SEQ ID NO: 147 - DNA, 420 bp, Streptomyces avermitilis
atgttaagaactatgttcaagagtaagattcatagggctaccgttacccaggcagatctacattatgttggttctgttaccattgacgcagatttgttggatgcagcagacttgttaccaggtgaactcgttcacattgtcgatatcaccaacggtgccagactggaaacttatgtcattgaaggtgagagaggcagtggtgttgtcggcattaacggtgccgcagcacacttggttcatccaggtgacttggtcatcatcatttcttacgcacaagtctccgatgccgaagctagagcattgagacctagagtcgttcacgttgacagagacaatagagttgttgctcttggtgcagatccagctgagccagttccaggttccgatcaagcgagatctcctcaagctgttactgcataa

SEQ ID NO: 148 - DNA, 384 bp, Bacillus licheniformis
atgtatagaaccttgatgagtgcaaagcttcacagagcaagagtcactgaagcaaacttgaactacgttggttctgttactattgacgaagacttacttgatgcagtcggtatgatggcaaacgagaaagttcaaattgtcaacaataacaatggtgcgcgtcttgaaacctatatcattcctggtgaacgtggttccggtgtcgtctgcttgaatggcgcagctgcaaggctcgtccaagttggtgacgtcgtcatcattgtttcttatgcaatgatgtccgaagaagaagccaaaacacataagccaaaggtcgctgtcctcaatgaaagaaacgaaattgaggaaatgttaggtcaggaaccagcgagaaccatcttataa

SEQ ID NO: 149 - DNA, 384 bp, Bacillus licheniformis; identical to SEQ ID NO: 148

SEQ ID NO: 150 - DNA, 384 bp, Bacillus licheniformis
atgtacagaacgttaatgtctgccaagttacacagagcgagagttactgaagcaaatctcaactatgttggttcagttaccattgatgaggatctattggatgctgttggtatgatggcaaatgaaaaggttcaaatcgtcaataacaacaatggtgctagattagaaacttacatcattcctggtgaaagaggttcaggtgttgtttgcttaaacggtgctgccgcaagattagttcaagtcggtgatgttgttatcatcgtctcttatgctatgatgagtgaggaagaagctaagactcataagcctaaggttgccgttctcaatgagagaaacgaaatcgaagaaatgcttggccaagaacctgccagaaccatcctgtaa

SEQ ID NO: 151 - DNA, 384 bp, Bacillus licheniformis
atgtatagaacattgatgtctgcaaagttgcatagggctcgtgttactgaggcaaatctaaactacgtcggttccgtcacaatcgatgaagatctactcgatgccgttggtatgatggccaatgaaaaagttcaaattgtcaacaacaacaacggtgcaagattggagacctatatcattcctggtgaaagaggttcaggtgttgtttgtctgaacggtgctgctgcgaggttggtccaagtcggtgatgttgtcattatcgtttcttatgcaatgatgtcagaagaagaagctaagacccataagccaaaggttgctgttttgaacgaaagaaatgagattgaggaaatgttaggtcaagaaccagcaagaacaatcttataa

SEQ ID NO: 152 - DNA, 945 bp, Metallosphaera sedula
atgaccgaaaaggtctccgtcgtcggtgcaggcgtcatcggtgtcggttgggctaccttgttcgcttccaagggttactccgtctccttgtacaccgaaaagaaggaaaccttggacaagggtatcgaaaagttgcgtaactacgtccaagtcatgaagaacaactcccaaatcaccgaagacgtcaacaccgtcatctccagagtttcccctactaccaacttggacgaagccgttagaggtgcaaacttcgtcatcgaggctgtcatcgaagactacgacgctaagaagaagatcttcggttacttggactccgtcttggacaaggaagttatcttggcatcctccacctccggtttgttgatcaccgaagtccaaaaggctatgtccaagcacccagaaagagctgtcatcgcccacccatggaacccaccacacttgttgcctttggtcgaaatcgttccaggtgagaagacctccatggaagtcgttgagagaaccaagtccttgatggaaaagttggacagaatcgtcgtcgttttgaagaaggaaatcccaggtttcatcggtaacagattggcattcgctttgttcagagaagctgtctacttggttgacgagggtgtcgcaaccgtcgaggacatcgacaaggttatgactgccgctatcggcttgagatgggccttcatgggtccattcttgacctaccacttgggtggtggtgagggtggtttggaatacttcttcaacagaggtttcggttacggtgccaacgaatggatgcacaccttggctaagtacgacaagttcccatacaccggtgtcaccaaggccatccagcaaatgaaggaatactccttcatcaagggtaagaccttccaagagatctccaagtggagagacgaaaagttgttgaaggtctacaagttggtctgggaaaagtaa

SEQ ID NO: 153 - DNA, 1728 bp, Issatchenkia orientalis; identical to SEQ ID NO: 48

SEQ ID NO: 154 - protein, 575 aa, Issatchenkia orientalis; identical to SEQ ID NO: 49

SEQ ID NO: 155 - DNA, 1167 bp, Issatchenkia orientalis; identical to SEQ ID NO: 117

SEQ ID NO: 156 - protein, 388 aa, Issatchenkia orientalis; identical to SEQ ID NO: 118

SEQ ID NO: 157 - DNA, 1683 bp, Aedes aegypti
atgccagccaacggaatgttcgacgtcgctctgcaggtcatcgacgactccaacgtgtctagtggatcggacagtgctggtgtgtctgaagatgaagatgttcaactgttttgcagtaaagggaataccatagtcccgaagccgttgaaaaaatccatatcgaaaatcaaggatgaagagttcagcaaaaccgccaaagcaaacgagaaacgatacgcaagtcttccgagccgtgaacatcaccagcaattcttgaccgacttcctgtcggaagtgctgaacaatgccgttttcaacgctaccgaacgggctaacaaagttctgaactgggtggatccggagcagctcaagcgaaccttggacctggaactgaaggacgagcccgattcacatgagaagctgctggaactgaccagggccaccataaagcactcggtcaaaaccggacatccctacttcatgaaccaactgttctcgtccgtcgatccgtacgggttcgctggacagatccttaccgatgcgttgaaccccagtgtctacacgttcgaagtgtctccggtgttcgtcctgatggaggaagtggtgctcaaagaaatgagaaccatcgttggctacccggacggaaccggagatggcattttctgcccaggtggttcgatggctaacggctattccattagctgtgcccgcttcaaacacatgcccgatgtcaagacaaaaggattacattcacttccgcgcttggtaatcttcacatctgaagacgctcattattcggtgaaaaaattggcatcgttcatgggcatcggctcggacaacgtgtacccaatccatacggacgccatcggcaagatcagagtggatcatctagagtcggaaattctgcgcgccaaatcggagggagccgtgccgtttatggtgtcggccaccgcaggaacaacagtgatcggagcgtttgatccgctggagcagatcgcagatctgtgcaaaaagtacaacctctggatgcacgtggatgccgcctggggtggtggtgcacttatgtccaagaagtaccgatcgctgcttaaaggaatcgaacgatcggactcggtcacctggaacccacacaaattgctcgccgctccgcagcaatgctccaccttcctgacccgccacgagggaatcctatcggagtgccactcgaccaacgcgacctatctcttccagaaggacaaattctacgacacccagtacgacaccggcgataagcacatccagtgtggtcgccgtgccgacgtcctcaaattttggttcatgtggcgtgccaagggcacttccgggctggaacagcacatcgacaaggtgttcgagaatgcggagcacttcaccagcagtattaaatcgcgagaaggttttgaaatggtcgtcgagaatcccgagtgtaccaacgtgtgcttctggtacgtgccacctggattgcggaacgtaccacgtgacagcgcagagttcaccgaacggctgcacaaggttgcccccaaggtcaaggaacgcatgatgcgggaaggttcgatgatgatcacataccaaccgatccacgataagcccaacttcttccgattggtcctgcagaactcggccctggacaaatcggacatgaactacatcatcgatgaaatcgaacgacttgctgcagatttgtaa

SEQ ID NO: 158 - DNA, 1683 bp, Aedes aegypti
atgccagccaacggtatgttcgacgttgcattgcaagttatcgacgactccaacgtctcctccggttccgactccgctggtgtctccgaagacgaagacgtccaattgttctgttctaagggcaacaccatcgtcccaaagccattgaagaagtccatctccaagatcaaggacgaagaattctccaagaccgctaaggcaaacgaaaagagatacgcctccttgccatccagagagcatcaccagcaattcttgaccgacttcttgtccgaagttttgaacaacgcagttttcaacgctaccgaaagagcaaacaaggtcttgaactgggttgacccagaacaattgaagagaaccttggacttggaattgaaggacgaaccagactcccacgaaaagttgttggaattgaccagagcaaccatcaagcactccgttaagaccggtcacccatacttcatgaaccaattgttctcctccgtcgacccatacggtttcgctggtcaaatcttgaccgacgctttgaacccatccgtctacaccttcgaagtttccccagtcttcgttttgatggaagaagtcgttttgaaggaaatgagaaccatcgttggttacccagacggcaccggtgacggtatcttctgtccaggtggttccatggcaaacggttactccatctcctgtgcaagattcaagcacatgccagacgttaagaccaagggtttgcactccttgccaagattggtcatcttcacctccgaagacgcccactactccgtcaagaagttggcttccttcatgggtatcggctccgacaacgtctacccaatccacaccgacgcaatcggcaagatcagagtcgaccacttggaatccgaaatcttgagagccaagtccgaaggtgcggttcctttcatggtctccgctactgctggcactaccgttatcggtgcattcgacccattggaacaaatcgcagacttgtgcaagaagtacaacttgtggatgcacgtcgacgctgcttggggtggtggtgctttgatgtccaagaagtacagatccttgttgaagggtatcgaaagatccgactccgttacctggaacccacacaagttgttagccgcacctcaacaatgttccaccttcttgaccagacacgaaggtatcttgtccgaatgtcactccaccaacgcaacctacttgttccaaaaggacaagttctacgacacccaatacgacaccggtgacaagcacatccaatgtggtagaagggcagacgtcttgaagttctggttcatgtggcgtgccaagggcacctccggtttggaacaacacatcgacaaggttttcgaaaacgctgaacacttcacctcctccatcaagtccagagaaggtttcgaaatggttgttgagaacccagaatgtaccaacgtctgtttctggtacgtcccaccaggtttgagaaacgtccctagagactccgctgaattcaccgaaagattgcacaaggtcgcaccaaaggtcaaggaaagaatgatgagagaaggttccatgatgatcacctaccaacctatccacgacaagccaaacttcttccgtttggttttgcaaaactccgcattggacaagtccgacatgaactacatcatcgacgagatcgagagattggcagcagacttgtaa

SEQ ID NO: 159 - DNA, 1683 bp, Aedes aegypti
atgccagccaacggtatgttcgacgttgctttgcaagttatcgacgactccaacgtttcctccggttccgactccgcaggtgtttccgaagacgaagacgtccaattgttctgctccaagggtaacaccatcgtcccaaagccattgaagaagtccatctccaagatcaaggacgaggaattctccaagaccgctaaggcaaacgaaaagagatacgcgtccttgccttccagagaacatcaccagcaattcttgaccgacttcttgtccgaagtcttgaacaacgcagttttcaacgctaccgaaagagcaaacaaggtcttgaactgggttgacccagagcaattgaagagaaccttggacttggaattgaaggacgaaccagactcccacgaaaagttgttggaattgaccagggcaaccatcaagcactccgtcaagaccggtcacccttacttcatgaaccaattgttctcctccgtcgacccatacggtttcgctggtcaaatcttgaccgacgctttgaacccatccgtttacaccttcgaagtctccccagttttcgtcttgatggaagaggttgtcttgaaggagatgagaaccatcgtcggttacccagacggcaccggtgacggcatcttctgtccaggtggttccatggcaaacggttactccatctcctgtgcaagattcaagcacatgccagacgtcaagaccaagggtttgcactccttgccaagattggtcatcttcacctccgaagacgctcactactccgtcaagaagttggcttccttcatgggtatcggttccgacaacgtctacccaatccacaccgacgcaatcggtaagatcagagttgaccacttggaatccgaaatcttgagagctaagtccgaaggtgcagtccctttcatggtctccgcaaccgcaggcactaccgtcatcggtgcattcgaccctttggagcaaatcgcagacttgtgtaagaagtacaacttgtggatgcacgttgacgctgcttggggtggtggcgcattgatgtccaagaagtacagatccttgttgaagggtatcgagagatccgactccgtcacctggaaccctcacaagttgttagccgctccacagcaatgttccaccttcttgaccagacacgaaggtatcttgtccgaatgtcactccaccaacgcaacctacttgttccaaaaggacaagttctacgacacccaatacgacaccggtgacaagcacatccaatgcggtagaagggcagacgtcttgaagttctggttcatgtggcgtgcaaagggcacctccggtttggagcaacacatcgacaaggtcttcgaaaacgccgaacacttcacctcctccatcaagtcccgtgaaggtttcgagatggtcgtcgaaaacccagagtgcaccaacgtctgtttctggtacgtccctccaggtttgagaaacgtcccacgtgactccgctgaattcaccgagagattgcacaaggttgccccaaaggtcaaggaacgtatgatgagagagggttccatgatgatcacctaccaaccaatccacgacaagccaaacttcttcagattggttttgcagaactccgcattggacaagtccgacatgaactacatcatcgacgagatcgaaagattggctgccgacttgtaa

SEQ ID NO: 160 - DNA, 1683 bp, Aedes aegypti
atgcctgcaaacggtatgttcgacgtcgcattgcaagttatcgacgactccaacgtctcctccggttccgactccgctggtgtctccgaagacgaagacgtccagttgttctgttccaagggtaacaccatcgtccctaagccattgaagaagtccatctccaagatcaaggacgaagaattctccaagaccgcaaaggcaaacgaaaagagatacgcttccttgccatccagagagcatcaccagcaattcttgaccgacttcttgtccgaagttttgaacaacgcagtcttcaacgctaccgagagagccaacaaggtcttgaactgggtcgacccagaacaattgaagagaaccttggacttggaattgaaggacgaaccagactcccacgaaaagttgttggagttgaccagagctaccatcaagcactccgtcaagaccggtcacccttacttcatgaaccaattgttctcctccgtcgacccatacggtttcgcaggccaaatcttgaccgacgctttgaacccttccgtctacaccttcgaagtctccccagttttcgtcttgatggaagaagtcgttttgaaggagatgagaaccatcgttggttacccagacggcaccggtgacggcatcttctgtccaggcggttccatggcaaacggttactccatctcctgtgcacgtttcaagcacatgccagacgtcaagaccaagggtttgcactccttgccaaggttggtcatcttcacctccgaagacgcccactactccgttaagaagttggcatccttcatgggtatcggttccgacaacgtctacccaatccacaccgacgcaatcggtaagatcagggttgaccacttggaatccgaaatcttgagagctaagtccgaaggtgctgtcccattcatggtctccgcaaccgctggcactaccgtcatcggtgccttcgaccctttggaacaaatcgccgacttgtgcaagaagtacaacttgtggatgcacgttgatgctgcgtggggtggtggtgcgttgatgtccaagaagtacagatccttgttgaagggtatcgaacgttccgactccgtcacctggaacccacacaagttgttagcggcaccacaacagtgctccaccttcttgaccagacacgagggtatcttgtccgaatgccactccaccaacgctacctacttgttccagaaggacaagttctacgacacccaatacgacactggcgacaagcacatccagtgtggtagaagagcagacgttttgaagttctggttcatgtggagagctaagggcacctccggtttggaacaacacatcgacaaggtcttcgaaaacgccgaacacttcacctcctccatcaagtccagagaaggtttcgaaatggttgtcgaaaacccagaatgtaccaacgtttgtttctggtacgttccaccaggtttgaggaacgtcccaagagactccgcagagttcaccgaaagattgcacaaggtcgcacctaaggttaaggaaagaatgatgagagagggttccatgatgatcacctaccaacctatccacgacaagccaaacttcttcaggttggtcttgcaaaactccgcgttggacaagtccgacatgaactacatcatcgacgagatcgaaagattggcagcagacttgtaa

SEQ ID NO: 161 - DNA, 1683 bp, Aedes aegypti
atgcctgcaaacggtatgttcgacgtcgctttgcaagtcatcgacgactccaacgtctcctccggttccgactccgcaggcgtctccgaagacgaagacgttcaattgttctgttccaagggtaacaccatcgttccaaagccattgaagaagtccatctccaagatcaaggacgaagaattctccaagaccgctaaggcaaacgagaagagatacgcttccttgccatccagagaacatcaccaacaattcttgaccgacttcttgtccgaagttttgaacaacgctgtcttcaacgctaccgaaagagccaacaaggtcttgaactgggtcgacccagaacaattgaagagaaccttggacttggaattgaaggacgagccagactcccacgagaagttgttggaattgaccagagctaccatcaagcactccgtcaagaccggtcacccatacttcatgaaccagttgttctcctccgtcgacccatacggtttcgctggtcaaatcttgaccgacgcattgaacccttccgtttacaccttcgaagtttcccctgtcttcgtcttgatggaagaagtcgtcttgaaggaaatgagaaccatcgtcggttacccagacggcactggcgacggtatcttctgtcctggtggttccatggccaacggttactccatctcctgtgctagattcaagcacatgccagacgttaagaccaagggtttgcactccttgcctagattggtcatcttcacctccgaagacgctcactactccgttaagaagttggcctccttcatgggtatcggttccgacaacgtctacccaatccacaccgacgcaatcggtaagatcagagtcgaccacttggagtccgaaatcttgagagcaaagtccgaaggcgcagtcccattcatggtctccgcgaccgcaggcactaccgtcatcggtgctttcgacccattggaacagatcgcagacttgtgtaagaagtacaacttgtggatgcacgtcgatgccgcttggggtggtggcgctttgatgtccaagaagtacagatccttgttgaagggcatcgagagatccgactccgttacctggaacccacacaagttgttggctgctccacaacaatgttccaccttcttgaccagacacgagggtatcttgtccgaatgtcactccaccaacgctacctacttgttccaaaaggacaagttctacgacacccaatacgacaccggtgacaagcacatccaatgtggtagaagggcagacgtcttgaagttctggttcatgtggagggcaaagggcacctccggtttggagcaacacatcgacaaggtcttcgaaaacgctgaacacttcacctcctccatcaagtccagagaaggcttcgaaatggtcgttgaaaaccctgaatgtaccaacgtctgcttctggtacgtcccaccaggtttgaggaacgtccctagagactccgctgaattcaccgaacgtttgcacaaggtcgcaccaaaggttaaggaaaggatgatgagagaaggttccatgatgatcacctaccaaccaatccacgacaagccaaacttcttcagattggttttgcaaaactccgcattggacaagtccgacatgaactacatcatcgacgaaatcgaaagattggcagcagacttgtaa

SEQ ID NO: 162 - protein, 560 aa, Aedes aegypti
MPANGMFDVALQVIDDSNVSSGSDSAGVSEDEDVQLFCSKGNTIVPKPLKKSISKIKDEEFSKTAKANEKRYASLPSREHHQQFLTDFLSEVLNNAVFNATERANKVLNWVDPEQLKRTLDLELKDEPDSHEKLLELTRATIKHSVKTGHPYFMNQLFSSVDPYGFAGQILTDALNPSVYTFEVSPVFVLMEEVVLKEMRTIVGYPDGTGDGIFCPGGSMANGYSISCARFKHMPDVKTKGLHSLPRLVIFTSEDAHYSVKKLASFMGIGSDNVYPIHTDAIGKIRVDHLESEILRAKSEGAVPFMVSATAGTTVIGAFDPLEQIADLCKKYNLWMHVDAAWGGGALMSKKYRSLLKGIERSDSVTWNPHKLLAAPQQCSTFLTRHEGILSECHSTNATYLFQKDKFYDTQYDTGDKHIQCGRRADVLKFWFMWRAKGTSGLEQHIDKVFENAEHFTSSIKSREGFEMVVENPECTNVCFWYVPPGLRNVPRDSAEFTERLHKVAPKVKERMMREGSMMITYQPIHDKPNFFRLVLQNSALDKSDMNYIIDEIERLAADL

SEQ ID NO: 163 - protein, 563 aa, Culex quinquefasciatus
MPTNGMFDVALQVIEDANLSSGSDSAGVSEDEDVQLFCTTGNVVSSKPLKKPSLKPVTTVKDEDQNKMKTNAKRYASLPNREQHQRFLTDFLSEVLNNAIFNATDRSNKVLNWVDPEELKRSIDLSLKAEPDSDEKLLELARATIDHSVKTGHPYFMNQLFSSVDVYGFAGQCLTDALNPSVYTFEVSPVFVLMEEVVLKEMRTIVGFPGGVGDGIFCPGGSMANGYAISCARFKHMPDVKTKGLHSLPRLVIFTSEDAHYSIKKLASFMGIGSDNVYPIRTDAVGKIQPDHLEAEILRAKSEGALPFMVSATAGTTVIGAFDPLEQIADLCQKYNLWMHVDAAWGGGALMSKKYRTLLKGVERADSVTWNPHKLLAAPQQCSTFLTRHEGILSGCHSTNATYLFQKDKFYDTQYDTGDKHIQCGRRADVLKFWFMWRAKGTSGFEQHIDKVFENAEYFTNSIKARPGFEMVIENPECTNVCFWYVPPGLRQVPRDSAEFGERLHKVAPKVKERMMREGSMMITYQPIHDKPNFFRLVLQNSGLDKSDMNYIIDEIERLASDL

SEQ ID NO: 164 - protein, 567 aa, Anopheles gambiae
MPANGVCSVGLEVIEDNATYASGSDSAGVSEDEDVQQLFVSGADRVTSVLPKKSDIRKASQVDEQAAAAAAAAVSEKRYASLPNREQHQQFLTQFLTEVLNSAVFNATDRANKVLNWVDPEELQRTLDLALKDEPDTHEKLLELTRATIRHSVKTGHPYFMNQLFSSVDPYGFAGQVLTDALNPSVYTYEVSPVFVLMEEVVLREMRTIVGYPDGEGDGIFAPGGSMANGYAISCARHKFMPDIKTKGLHALPRLVIFTSEDAHYSVKKLASFMGIGSDNVYAIKTDNVGKIRVEHLESEILRAKSEGALPFMVSATAGTTVIGAFDPLEQIADLCAKYNLWMHVDAAWGGGALMSKKYRTLLKGIERSDSVTWNPHKLLAAPQQCSTLLTRHRNILAEAHSTNATYLFQKDKFYDTRYDTGDKHIQCGRRADVLKFWFMWRAKGTAGFEAHIDKVFENAEHFTSSIKARPGFEMVIEQPECTNVCFWYVPPGLRGVPRDSAEYRDRLHKVAPKVKERMMKDGSMMITYQPIHDKPNFFRLVLQNSSLDKSDMNYIIDEIERLGKDL

SEQ ID NO: 165 - protein, 540 aa, Tribolium castaneum
MPATGEDQDLVQDLIEEPATFSDAVLSSDEELFHQKCPKPAPIYSPVSKPVSFESLPNRRLHEEFLRSSVDVLLQEAVFEGTNRKNRVLQWREPEELRRLMDFGVRSAPSTHEELLEVLKKVVTYSVKTGHPYFVNQLFSAVDPYGLVAQWATDALNPSVYTYEVSPVFVLMEEVVLREMRAIVGFEGGKGDGIFCPGGSIANGYAISCARYRFMPDIKKKGLHSLPRLVLFTSEDAHYSIKKLASFQGIGTDNVYLIRTDARGRMDVSHLVEEIERSLREGAAPFMVSATAGTTVIGAFDPIEKIADVCQKYKLWLHVDAAWGGGALVSAKHRHLLKGIERADSVTWNPHKLLTAPQQCSTLLLRHEGVLAEAHSTNAAYLFQKDKFYDTKYDTGDKHIQCGRRADVLKFWFMWKAKGTSGLEKHVDKVFENARFFTDCIKNREGFEMVIAEPEYTNICFWYVPKSLRGRKDEADYKDKLHKVAPRIKERMMKEGSMMVTYQAQKGHPNFFRIVFQNSGLDKADMVHLVEEIERLGSDL

SEQ ID NO: 166 - protein, 600 aa, Attagenus smirnovi
  misc_feature (36)..(36): Xaa can be any naturally occurring amino acid
MVTIWPTSPQGKVIAARPARDPSTSYNGGFAAQYRXFVIQSCKQLNFSSRGITNHARQRRSEKYNLEEDVTDEATSNSDHSPSEDDDLYVRHTNGFNIKPSKPIIEPRKFATFPSVPDKEHHEDFIKACVDILLKEAVFDGTNRKNRVLEWHSPEELKKLFDFNLRKSGSSHEELTRLIKDTIHYSVKTGHPYFVNQLFSSVDLYGLVGQWLTDALNPSVYTYEVSPVFTLMEETVLREMRTIVGFEDGKGDGIFCPGGSMANGYAISCARYKFKPDIKDTGLHGLPRLVLFTSEDAHYSIKKMASLLGIGSNNVYLIKTDELGRMSVPHLVEQIERVHKEGGAPFMVSATAGTTVLGAFDPIQELADVCERYNLWLHVDAAWGGGALISQRHRHLLTGINRADSVTWNPHKLLTAPQQCSTLLLRHEGILAGAHSANAAYLFQKDKFYDTRYDTGDKHVQCGRRADVLKFWFMWKAKGTIGFEQHIDKVFDNAKFFSDNIRHRPGFRMVLEDPECTNICFWYVPPSMRGCEDQQDFNERLHKVAPKIKERMMKEGSMMVTYQPQKSLPNFFRIVFQNSGLERSDMLHLIKEFERLGHDL

SEQ ID NO: 167 - protein, 537 aa, Acyrthosiphon pisum
MPIVMPAATVPTDYATARPVELMVTASTLDETPCGKGPMMESLSAAVCGYKSAPNAADHEAFVRDAVRLMLEQAVFRGTDRRRPVLNWKSPEELQAAFDFALDRSPTTHGHLLNLIEDTIEHSVKTGHPYFINQLFSSVDPYGLIGQWLTDALNPSVYTFEVAPVMTIMEETVLTEMRKFLGYPDGKGDGIFCPGGSIANGYAINCARFSAFPEVKTRGMHGLPRLVVYTSADAHYSIKKLCAFEGIGSDNLYLINTDAKGKMDVSHLRQQIQRTLEEKAVPIMVSATAGTTVLGAFDPIAEIADVCHEYGIWLHVDAAWGGGALVSKKHKHLLTGIDRADSVTWNPHKMLTAPQQCSTFLTKHERVLTESNSSCAQYLFQKDKFYDTTYDTGDKHIQCGRRADVFKFWFMWKAKGTDGLEAHVDENFDNAKYFTEMIRNRAGFKLVLEEPEYTNITFWYIPPSLRGRQNEPDFKNKLHKVAPRIKERMMKEGTMMITYQPSDDLPNFFRLVLQNSSLDQNDMDYFVNEIERLGSDL

SEQ ID NO: 168 - protein, 576 aa, Drosophila sechellia
MLASENFPTHHFKESIFKPYSTTSGDDLASVTPLTATAALVASTPSPADSTSAVAFEQASKMLATAANNNNNNNNNNITSTKDDLSSFVASHPAAEFEGFIRACVDEIIKLAVFQGTNRSSKVVEWHEPAELRQLFDFQLREQGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYRHSPESKKNGLFNAKPLIIFTSEDAHYSVEKLAMFMGFGSEHVRKIATNEVGKMRLSDLEEQVKQCLENGWQPLMVSATAGTTVLGAFDDLAGISELCKKYNMWMHVDAAWGGGALMSKKYRHLLNGIERADSVTWNPHKLLAASQQCSTFLTRHQQVLAQCHSTNATYLFQKDKFYDTSFDTGDKHIQCGRRADVFKFWFMWKAKGTQGLEAHVEKVFRMAEFFTAKVRERPGFELVLESPECTNISFWYVPPGLREMERNREFYDRLHKVAPKVKEGMIKKGSMMITYQPLRQLPNFFRLVLQNSCLEESDMVYFLDEIESLAQNL

SEQ ID NO: 169 - protein, 575 aa, Drosophila melanogaster
MLASENFPTHHFKESIFKPYSTTSGDDLASVSPLTATAALVASTSSPADSTSTVAFEQASKMLANAANNNNNNNNNITSTKDDLSSFVASHPAAEFEGFIRACVDEIIKLAVFQGTNRSSKVVEWHEPAELRQLFDFQLREQGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYRHSPESKKNGLFNAKPLIIFTSEDAHYSVEKLAMFMGFGSDHVRKIATNEVGKMRLSDLEKQVKLCLENGWQPLMVSATAGTTVLGAFDDLAGISEVCKKYNMWMHVDAAWGGGALMSKKYRHLLNGIERADSVTWNPHKLLAASQQCSTFLTRHQQVLAQCHSTNATYLFQKDKFYDTSFDTGDKHIQCGRRADVFKFWFMWKAKGTQGLEAHVEKVFRMAEFFTAKVRERPGFELVLESPECTNISFWYVPPGLREMERNREFYDRLHKVAPKVKEGMIKKGSMMITYQPLRQLPNFFRLVLQNSCLEESDMVYFLDEIESLAQNL

SEQ ID NO: 170 - protein, 508 aa, Danaus plexippus
MRVDSKIIVKKETQDENLYQSLAERSKHEEFLRKAVDLLVERVVFGRSTRSSKVVEWAAPDEIKKAIDLKPRLGPASHDELLAFMANVARYSVNTGHPYFVNQLFSSVDPYGLVGQWLTDALNPSVYTFEVAPVFTLMEEEVLREMRKIVGWPEGEGDGIFCPGGSIANGYAISCARHHFYPEVKYKGVHAVPKLVLFTSELAHYSTKKMAAFMGIGSDNCVNIKTDDVGKMNIVDLEMKIKIAIDNKCTPFMVTATSGTTVFGAFDPLVAISDLCKKYNLWLHVDAAWGGGALMSKKHRHLLNGIELADSVTWNPHKLLAAPQQCSTFLTRHKKVLSEGHSSNAKYLFQKDKFYDTSYDTGDKHIQCGRRADVLKFWFMWKAKGTEGFEKHVDKLFDNAKYFLDHIKQREGFQLVIAEPQCTNIMFWYIPKCLRGCENDADYYERLHKVAPKIKERMIKEGSMMVTYQPQGDLVNFFRIVFQNSALDHKDMVYFANEFERLGSDMIV

SEQ ID NO: 171 - protein, 570 aa, Drosophila yakuba
MLASENFPTHHFKESIFKPYSTSGDDLASATPLTAAAALVATTSSPADSSSAVAFETASKMLATNNNNNNNITSSKDDLSSFVASHPAAEFEGFIRACVDEIIKLAVFQGTNRSSKVVEWHEPAELRQLFDFQLREKGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYRHSPESKKNGLFNAKPLIIFTSEDAHYSVEKLAMFMGFGSEHVRKIATNEVGKMRLSDLEEQVKQCLENNWQPLMVSATAGTTVLGAFDDLAGISELCKKYNMWMHVDAAWGGGALMSKKYRHLLSGIERADSVTWNPHKLLAASQQCSTFLTRHQQVLAQCHSTNATYLFQKDKFYDTSFDTGDKHIQCGRRADVFKFWFMWKAKGTQGLEAHVEKVFRMAEFFTAKVRERPGFELVLESPECTNISFWYVPPGLREMERNREFYDRLHKVAPKVKEGMIKKGSMMITYQPLRQLPNFFRLVLQNSCLEESDMVYFLDEIESLAQNL

SEQ ID NO: 172 - protein, 572 aa, Drosophila erecta
MLASENFPTHHFKESIFKPYSTSGDDLASVTPLTAAAALVASTSSPADSSSAVAFETASKMLTTTNSNNNNNNTTSAKDDLSSFVASHPAAEFEGFIRACVDEIIKLAVFQGTNRSSKVVEWHEPAELRQLFDFQLREKGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYRHSPESKKNGLFNAKPLIIFTSEDAHYSVEKLAMFMGFGSEHVRKIATNEVGKMRLSDLEEQVKQCLENDWQPLMVSATAGTTVLGAFDDLAGISDVCKKYNMWMHVDAAWGGGALMSKKYRHLLSGIERADSVTWNPHKLLAASQQCSTFLTRHQQVLAQCHSTNATYLFQKDKFYDTSFDTGDKHIQCGRRADVFKFWFMWKAKGTQGLEAHVEKVFRMAEFFTAKVRERPGFELVLESPECTNISFWYVPPGLREMERNREFYDRLHKVAPKVKEGMIKKGSMMITYQPLRQLPNFFRLVLQNSCLEESDMVYFLDEIESLAQNL

SEQ ID NO: 173 - protein, 508 aa, Papilio xuthus
MPADSNLIVAGEAIKESLFQSLPERSKHEEFIRRAVDLLVERVVFGRSQRSAKVVEWAAPDEIKSVIDLKPREGPVSHDELLAIMADVARYSVNTGHPYFVNQLFSTVDPYGLIGQWLTDALNPSVYTYEVAPVFTLMEEEVLREMRAIVGWKDGDGDGIFCPGGSISNGYAISCARHHFYPDVKSKGVYAVPKLVLFTSELAHYSTKKMACFMGIGSDNCIMIKTDELGKMDVGDLEIKISEAINSGSTPFMVTATAGTTVFGAFDPLIPISDLCKKYNLWLHVDAAWGGGALMSKKHRHLLKGIELADSVTWNPHKLLAAPQQCSTFLVRHKNVLKEGHSSNAKYLFQKDKFYDTSYDTGDKHIQCGRRADVLKFWFMWKAKGSDGFEKHIDKLFDNAKYFLDHIKQRAGFKLVLENPECTNIMFWYVPNCLRGCENDPNYRERLHKVAPKIKERMIKEGSMMVTYQPQGNLVNFFRIVFQNSALDHKDMVYFANEFERLGSDIIV

SEQ ID NO: 174 - protein, 589 aa, Drosophila persimilis
MLASETFPAHRFKESIFKPYSTSGSASVDDLASVNKTLTSAATTSSSPDTHAAVDIAPTASSVEFETARKMLTNNSSSSSNNSNNNNNNNNNDAKDDISGFVASHPAAPFEGFIRACVDEIIKLAVFQGTNRSTKVVEWHEPAELRQLFDFQLRDKGEPQEKLRELLRETIRFSVKTGHPYFINQLYSGVDPYALVGQWLTDALNPSVYTYEVAPLFTLMEEQVLAEMRRIVGFPNGGKGDGIFCPGGSIANGYAISCARYTYAPESKKNGLFNAKPLIIFTSEDAHYSVEKLAMFMGFGSEHVVKIATNEVGKMRLSDLEDQVRRCLDNGWQPLMVSATAGTTVLGAFDDLTGIGDLCRKYNMWMHVDAAWGGGALMSKKYRHLLNGIERADSVTWNPHKLLAASQQCSTFLTRHQLVLGQCHSTNAAYLFQKDKFYDTSYDTGDKHIQCGRRADVFKFWFMWKAKGNLGLESHVEKVFRMAEFFTAKVRERPGFELVLESPECTNISFWYVPPSLRTMERDREFYDKLHKVAPKVKERMIKKGSMMITYQPLRQLPNFFRLVLQNSCLEESDMIYFLDEIESLAKNL

SEQ ID NO: 175 - protein, 511 aa, Bombyx mori
MPADSDLIVAEREDLGIDRTLYKSLSERSKHEDFIRRAVDLLVERVVFGRSLRTSKVVEWAVPSEIKKAIDLKPRDGPISHDELLGLMADVARYSVNTAHPYFVNQLYSSVDPYGLVGQWLTDALNPSVYTYEVAPVFTLMEEEVLKEMRVLVGWKDGEGDGIFCPGGSIANGYAISCARFHFYPEIKTKGVYAVPKLTLYTSELAHYSTKKLAAFMGIGDENCVLIKTDKYGKIDVEDLEAKIVEGIEEGAAPFLVTATAGTTVFGAFDPLVPIAALCKKYNLWLHVDAAWGGGALMSKKHRHLLNGIELADSVTWNPHKLLAAPQQCSTFLIRHKNVLKEGHSCNAKYLFQKDKFYDTSYDTGDKHIQCGRRADVLKFWFMWKAKGSDGFENHIDTLFDNARFFLEQIRNREGFELVIEKPECTNIMFWYVPRCLRGCENESDYRERLHKVAPKIKELMIKEGSMMVTYQPQGDLVNFFRIVFQNSALDHKDMIYFVNEFERLGRDILV

SEQ ID NO: 176 - protein, 578 aa, Drosophila ananassae
MLASKNYPTHHFKESIFKPYSTSGDDLASVNTLTASAASAAMVATTSSSADTVAVDFENARRMLATNGGIASNGNNNNNVLDSKDSLSGFVASHPAAQFDGFIRACVDEIIKLAVFQGTNRSSKVVEWHEPAELRQLFDFQLREKGESQDKLRELLRETIRFSVKTGHPYFINQLYSGVDPYALVGQWLTDALNPSVYTYEVAPLFTLMEEQVLAEMRRIVGFPNGGQGDGIFCPGGSIANGYAISCARYKYTPESKKNGLFNAKPLIIFTSEDAHYSVEKLAMFMGFGSEHVRKIATNEVGKMRVEDLENQIKMCLENNCQPLMVSATAGTTVLGAFDDLVGISELCKKYNMWMHVDAAWGGGALMSKKYRHLLNGIERADSVTWNPHKLLAASQQCSTFLTPHQQILAQCHSTNATYLFQKDKFYDTSFDTGDKHIQCGRRADVFKFWFMWKAKGSQGLEAHVEKVFRMAEFFTAKVRERPGFELVLDQPECTNISFWYVPPSLRQMERNREFYDRLHKVAPKVKEGMIKKGSMMITYQPLRQLPNFFRLVLQNSCLEESDMLYFLNEIESLAQNL

SEQ ID NO: 177 - protein, 580 aa, Drosophila mojavensis
MLASENFQAHLYNRSSIYKPYNEELASMAKQLTTATADAAGIDAAQAAVDYGSPSKQMLGSNNGSSSGSSNKTSSANSNNNNNNVANGLSSFVASHPSAEFEGFIRACVDEIIQLAVLQGTNRSSKVVEWHEPAELRKLFDFELRDQPDSPDKLRQLLRETIRFSVKTGHPYFINQLYSGVDPYALIGQWLTDALNPSVYTYEVAPVFTLMEEQVLGEMRRIVGFPNNGQGDGIFCPGGSIANGYAISCARYQYAPESKKNGLFNAKPLVIFTSEDAHYSVEKLAMFMGFGSEHVRKIATNELGKMRLSDLEQQIQFCLDNNWQPLMVSATAGTTVLGAFDDLLGISELCRKHNMWMHVDAAWGGGALMSKKYRQLLNGIERADSVTWNPHKLLSASQQCSTFLTRHTQILGQCHSTNAAYLFQKDKFYDTSFDTGDKHIQCGRRADVFKFWFMWKAKGTKGFEAHVEQVFEMSEYFTNKLRERPGFELVLDKPECTNITFWYVPPSLRQMERNQEFYDKLHKVAPKIKEAMIKKGSMMITYQPLRKLPNFFRLVLQNSCLDESDMLYFLNEIETLGQKL

SEQ ID NO: 178 - protein, 588 aa, Drosophila grimshawi
MLASKTFPTHHFKKSIYTTYNGASAPTNVEDLANVAKTLTTTTSSSSDSTVVEANTSPVEFSTPSKMLSSTSTTTTTTTNNNNNNNSNNNNNIVNGLSSFVASHPAAEFEGFIRACVDEIIHLAVFQGTDRASKVVEWHEPAELRKLFDFELREKGESQEKLRQLMRETIRYSVKTGHPYFINQLYSGVDPYALVGQWLTDALNPSVYTYEVAPVFTLMEEQVLAEMRRIVGFPDNGHGDGIFCPGGSIANGYAISCARYNYAPESKKNGLFNAKPLIIFTSEDAHYSVEKLAMFMGFGSENVRKIATNEVGKMRLSDLEEQIQLCLDNNWQPLMVSATAGTTVLGAFDDLVGISELCRKHNMWMHVDAAWGGGALMSKKYRHLLNGIERADSVTWNPHKLLSASQQCSTFLTRHAQILGQCHSTNAAYLFQKDKFYDTSFDTGDKHIQCGRRADVFKFWFMWKAKGSKGFEAHVEQVFEMSEFFTAKLRERPGFELVLDHPECTNITFWYVPPSLRHMEHNQEFYDKLHKVAPKIKEAMIKKGSMMITYQPLRKLPNFFRLVLQNSCLEESDMLYFINEIESLGQNL

SEQ ID NO: 179 - protein, 461 aa, Biston betularia
SQRSAKVVEWAAPEEIKKAIDLKPRDGPASHDQLLGLMADVARYSVNTGHPYFVNQLFSSVDPYGLIGQWLTDALNPSVYTFEVAPVFTLMEEEVLKEMRSLVGWKNGDGDGIFCPGGSIANGYAISCARFYYYPDIKTKGVYAVPRLVLFTSELAHYSTKKMAAFMGIGSDNCILVKADKLGKMDAEDLEVKINEALDDGATPFLVTATAGTTVYGAFDPLAQISSLCKKYNLWLHVDAAWGGGALMSKKHRHLLTGIELADSVTWNPHKLLAAPQQCSTFLIKHKNVLKDGHSSNAKYLFQKDKFYDTSYDTGDKHIQCGRRADVLKFWFMWKAKGSEGFEQHIDTLFDNAKHFVYLIRNREGYRLVIEEPECTNIMFWYIPKCLRGCENEPDYKERLNKVAPKIKERMIKEGSMMVTYQPQGDLANFFRIVFQNSALDHKDMVYFANEFERLGRDIVV

SEQ ID NO: 180 - protein, 583 aa, Drosophila willistoni
MLASENFPTHHFKESIFKPYNATTSAANAAAAATVEDLANVAKTLTSKSTTSSSVASDAAATVSLMGAVDIETARKMLANNNVNINNNNNNNINNNNSKDTAEFESFLRGCIDEIIKLAVVEGTNRSSKVVEWHEPSELRQIFDFQLREKGESQDKLRELLRETIRFSVKTGHPYFINQLYSGVDPYALVGQWLTDSLNPSVYTYEVAPVFTLMEEEVLAEMRRIVGFPDNGLGDGIFCPGGSIANGYAISCARYKYAPESKKNGLFSGKPLIIFTSEDAHYSVEKLAMFMGFGSEHVRKIATNEVGKMRLSDLEQQIQLCLDNNWQPLMVSATAGTTVLGAFDDLVGISELCRKHNMWMHVDAAWGGGALMSKKYRHLLNGIERADSVTWNPHKLLAASQQCSTFLTRHQQILGQCHSTNATYLFQKDKFYDTSYDTGDKHIQCGRRADVFKFWFMWKAKGSEGLRAHVEQVFRMSEYFTQQVRERPGFELVLESPECTNISFWYIPPSLRHMERNQEFYDKLHKVAPKIKEGMIKKGSMMITYQPLRRLPNFFRLVLQNSCLEESDMLYFLNEIESLGHQL

SEQ ID NO: 181 - protein, 548 aa, Apis mellifera
MPANEETLSMTSDQIRNNLLGKACDDSMQNNFDCESSGDDEEDYQNDCSRSIVKENFKEVCNYKSLPVREIHKKFMKSFVNLLLEEAVFEGTLRRNKVVEWIEPTTLHSIIDLKLSDQGCSYETLLTLAHNVIKYSVKTGHPRFINQLYSSVDPYGLLGQWLTDALNPSVYTYEVSPVFSLMEEEILREMRKIVGWKDGRSEGIFCPGGSIANGYAINLARYYKFPQSKELGLFNTGRLIIFTSRDAHYSVKKLSAFLGIGTENVYEVKTDDKGKMCITDLKIQIKKALEEDAIPLMVSATAGTTVLGAFDPLKNIAAICKNYNLWFHVDAAWGGGALMSKKYKYLLDGIELADSVTWNPHKLLAAPQQCSTLLLRHEGLLQDAHGSKASYLFQPDKFYDTSFDSGDKHIQCGRRADVLKFWFMWKAKGTRGLEKHVDRVFKLARYFTNYIKHREGFKLILEPECTNVCFWYVPPSKRQLQNEELLKALQKIGPAVKERMMKKGSMLITYQPLRELPNFFRLVLQNSGLTETDMRFFAEEIERLAIDL

SEQ ID NO: 182 - protein, 586 aa, Drosophila virilis
MLASETFPTHHFKNSIYKPYNGASSAPDVEDLASMAKTLTTTTLSSSDAAVIDVVKTTVEYGNPNKMLNSSVSSSSNSNNKNNNIKNTNGNVNGLASFVASHPAAEFEGFIRACVDEIIKLAVFQGTNRSSKVVEWHEPAELRKLFDFELREKGESPDKLRQLLRETIRFSVKTGHPYFINQLYSGVDPYALVGQWLTDALNPSVYTYEVAPVFTLMEEQVLAEMRRIVGFPNNGHGDGIFCPGGSIANGYAISCARYKYAPESKKNGLFNAKPLIIFTSEDAHYSVEKLAMFMGFGSEHVRKIATNELGKMRLSDLEDQIQLCLDNNWQPLMVSATAGTTVLGAFDDLVGISELCRKHNMWMHVDAAWGGGALMSKKYRQLLNGIERADSVTWNPHKLLSASQQCSTFLTPHAQILGQCHSTNAAYLFQKDKFYDTSFDTGDKHIQCGRRADVFKFWFMWKAKGSKGFEAHVEQVFEMSEYFTAKLRERPGFELVLEKPECTNITFWYVPPSLRQMERNQEFFDKLHKVAPKIKEAMIKKGSMMITYQPLRKLPNFFRLVLQNSCLEESDMLYFLNEIEDLGQNL

SEQ ID NO: 183 - protein, 547 aa, Nasonia vitripennis
MPAHEETQLQEGSAIEALERPRSADSEKHSRLDYEREEEAHQIGEDSDEGYAMDNFNEEGFFCSLPGRESHEKFIRDAVEMILREAVFKGTSRKNRVVEWIEPATLPSKIDLPPRKTGESHEALLRLLDSVIRYSVKTGHPHFVNQLYSSVDPYGLVGQWLTDALNPSVYTYEVSPVFSLMEEAVLKEMRAIVGWQNGEGDGIFCPGGSMANGYAINLARHWMFPIVKEQGLTAVPRLVVFTSEDAHYSVKKLAAFLGIGIANVYSVKVDESGKMCVSDLRAQIDRAIQEGARPLMVSATAGTTVLGAFDPLRSIAELCREHNMWFHVDAAWGGGALVSPKHRHLLDGVELADSVTWNPHKLLAAPQQCSTLLTRHKGLLQSAHGCKATYLFQQDKFYDTSYDFGDKHVQCGRRADVLKFWLMWKAKGTDGLEKHVDRVFQLSRYFVGIIRNRPGWQLLFEPECTNVCFRYVPPSKRHLNGQDLFQALHKVAPLVKERMVKTGSMLITYQPIREQANFFRLVLQNSGLTEADMHFFVEEIERLSEDL

SEQ ID NO: 184 - protein, 508 aa, Bicyclus anynana
MPADSNIIVAVEEKKEDGLFQSLTERSKHEDFIRRAVDLLVERVVFGRASRTSKVVEWSAPEDIKQAIDLKVRDGPASHEELLAFMADVARYSVNTAHPYFVNQLFSSVDPYGLIGQWLTDALNPSVYTFEVAPVFTLMEEEVLREMRSIVGWADGEGDGIFCPGGSIANGYAISCARSYFYPEIKNKGVYAVPKLVIFTSELAHYSTKKMAVFMGIGSDNCILVKADENGRMDVNDFERKINEAIEAGATPFLVTSTSGTTVYGAFDPIVPISNICKKYNLWLHVDAAWGGGALMSRKHRNLLNGIEADSVTWNPHKLLAAPQQCSTFLLKHKNVLKEAHSSNAQYLFQKDKFYDTSYDTGDKHIQCGRRADVLKFWFMWKAKGSEGFEKHVEKLFDNANYFLEHIRQREGFRLVIPKPECTNIMFWYIPKCLRSCENEPNYYERLHKVAPKIKERMIKEGSMMVTYQPQGNLVNFFRIVFQNSALDHKDMIYFANEFERLGSDIVV

SEQ ID NO: 185 - protein, 543 aa, Harpegnathos saltator
MPANEDTSNESLERIEPGRISPSLSQRKMSGGLQNLASSLLPGATVDDDLESSRVEERNFRSIPRRDIHEKLFRDFFELVLQQAVFQSTSGKERVVEWMNPSDLRSVVDFSLPAEGVSHEELLALTRNVIKYSVKTGHPHFVNQLFSSLDPYGLLGQWLTDALNPSVYTYEVSPVFSLMEEDVLREMRRIIGWKGGEGLFCPGGSMANGYAINLARHHRYPNMKQTGLSQMPRLVIFTSEDAHYSVKKLAAFLGIGYDNVYSVKVDSRGKMLVSDLEAQIARATREGAVPLMVSSTAGTTVLGAFDPLKDIAEVCRKHRLWFHVDAAWGGGALVSRTYRRLLDGVELADSITWNPHKLLAAPQQCSTLLLRHEGLLQSAHGCGASYLFQNDKFYDSSYDCGDRHVQCGRRADVVKFWYMWKAKGTRGLEEHVDHVFALSRYFADLVRTRDGWHLLAEPECTNVCFRYIPPSMRDLAGRQLDQAIHKVAPMIKERMVRAGTMLMTYQPLRGTPNFFRLVLQNSGLSEIDMQFFVEEIERLAADL

SEQ ID NO: 186 - protein, 548 aa, Acromyrmex echinatior
MPANEDTSNDETSLRMKHERAGPSMESSWRKMSEEHPRANPSPIPNLPGLVNGIEERQGIEKWDFRSMPRRDAHEKLFRDFFELVLQRAVFQPTSGKDRVVEWVDPYDLRSVVDLSLPAEGVSHEKLLTLTRDIIKYSVKTSHPHFVNQLFSSLDPYGLLGQWLTDALNPSVYTYEVSPVFSLMEEDVLREMRAIISWQEGEGLFCPGGSMANGYAINLARHHRYPNLKQSGLSQMPRLVVFTSEDAHYSVKKLAAFLGIGYDNVYLVKVDSRGKMMVSDLEAQIARAVEEGAAPLMVSATAGTTVIGAFDPLREIAEVCRKHELWFHVDAAWGGGALISETYRGLLDGIQFADSVTWNPHKLLAAPQQCSTLLLRHEGLLQAAHGCGASYLFQNDKFYDASFDCGDRHVQCGRRADVVKFWYMWKAKGTRGLEAHVDRLFALSRHFTDLIRTRDGWHLLVEPECINVCFRYIPPSKRHLTGQELEQALHKIAPIIKERMVRAGTMLITYQTLRNMPNFFRLVLQNSGLTEADMKFFVEEIERLAMDL

SEQ ID NO: 187 - protein, 544 aa, Camponotus floridanus
MPANEDTSANDFAFKRIKPERANPAESQPKMSRKDDSSTNLILSNFTASVEERKEAEKGDFRSIPCRSVHEKLFRDFFELMLQRAVFQSTSGEERVVEWIDPNNLRSVVDLSLPTEGVSHEELLTLTRDIIKYSVKTGHPHFVNQLFSSLDPYGLLGQWLTDALNPSVYTYEVSPVFSLMEEDVLREMRAIIGWQGGEGLFCPGGSMANGYAINLARHHRYPNLKQSGLSQMPRLVVFTSEDAHYSVKKLAAFLGIGYDNVYLIKVDSRGKMVVTDLEAQIVRAINEGAVPLMVSATAGTTVMGTFDPLKKIAEVCRKHGLWFHVDAAWGGGALVSRTYRGLLDGIQLADSITWNPHKLLAAPQQCSTLLLRHEGLLQEAHGCGASYLFQNDKFYDATFDYGDRHVQCGRRADVVKFWYMWKAKGTRGLEAHVDCVFALSRYFADLIRTRDGWRLLAEPECTNVCFRYIPLSKRHLTGRELDQALHKIAPMIKERMMRAGTMLITYQTLRDMPNFFRLVLQNSGLTEADMKFFVEEIERLAVDL

SEQ ID NO: 188 - protein, 532 aa, Pediculus humanus
MFPVISTQKQSFGIINLSLLEDNNFLIKTNSVVDKSDKEDEKLNQKHWSLPLEKYHYDFIVKCVGIIMKEAVFDGTNRNSKVVQWQDPEKLKKSFDFSLNKYSETEGKLLHLISTIIKFSVKTGHPYFVNQLFSGVDPYGLIGQWLTDALNPSVYTYEVSPVFSIMEEVVLEEMRKFIGFPNGKGDGTFCPGGSISNGFGISCARYHLFPQVKKLGIYGIGLRLVLFTSRDAHYSIVKLATFMGLGSDNVISIKTDESGKMKPEELEKAILKVLQEGGTPFMVSATSGTTVLGAFDPLDSIADICEKYKLWFHVDAAWGGGCLMSSIHKKKLQGIHRTDSVTWNPHKLLGVPQQCSAFLTKHKNLLKNVHCAKATYLFQKDKFYDVKYDTGDKHIQCGRRADVLKFWFMWKAKGSSGFEKHINKIFETALYFKKSIENKPDFQLVLSEPECTNICFWYIPPRLQNSKYNNDDLNKVAPRMKEKMMKDGSMMITYQPLRHLPNFFRLVIVNSGLDTHDMDRLITIIQNAGASI

SEQ ID NO: 189 - protein, 549 aa, Atta cephalotes
MPANEDTSNDETSLRMKHERADSSAESSWRKMSEERPRANSSSLTLNLPGLVNGTEERQRAEKRDFRSMPRRDAHEKLFRDFFELVLQRAVFQSTSGKDRVVEWVDPYDLRSVVDLSLPAEGVSHEELLTLTRDIIKYSVKTGHPHFVNQLFSSLDPYGLLGQWLTDALNPSVYTYEVSPVFSLMEEDVLREMRAIIGWQGGEGLFCPGGSMANGYAINLARHHRYPNLKQSGLSQMPRLVVFTSEDAHYSVKKLAAFLGIGYDNVYLVKVDSRGKMMVSDLETQIAQAVKEGAAPLMVSATAGTTVIGAFDPLREIAEVCKKHGLWFHVDAAWGGGALVSGTYRDLLDGIQFADSVTWNPHKLLAAPQQCSTLLLRHEGLLQAAHGCGASYLFQNDKFYDASFDCGDRHVQCGRRADVIKFWYMWKAKGMRGFEAHVDHLFALSRHFTDLIRIRDGWHLLVEPECINVCFRYIPPSKRHLAGQELEQALHKIAPIIKERMVRAGTMLITYQTLRNMPNFFRLVLQNSGLTEVDMKFFVEEIERLAMDL

SEQ ID NO: 190 - protein, 497 aa, Daphnia pulex
MENPALIGWFQTEPSQEQHEQFMRKVMDIVLKEAVFEGTSRNNLVIEWMEPESLLTLLGKELPKNPQSDETLVELIKNVVRYSVKTGHPHFINQLFSSLDPYGLVAQWVTDSLNPSVYTYEVAPVFTLLEHQILREMRRWVGFPDGSGDGVFCPGGSMANIYGIQCARHRAMPSLKETGTFGSPRLVVLTSKDAHYSVKKACFLLGIGVSNLYLVDVDTSGRMDLVHLRQEVQRALNENARPFMVSATAGTTVLGATDPLDGIADICQEFGMWMHVDAAWGGGALMSTKHRHILKGIERADSVTWNPHKLLGVPQQCSTFLTRHADLLLEANSASASYLFQKDKFYDPKWDVGDKYLQCGRRADVLKFWLMWQAKGSLGLEKHVDTLFENVAYFTSFIRNRKGFQLVLEEPPFVNVCFWYIPPSLQGAQHDEDYEEKLHKIAPKIKERMIKKGSMMITYQPLRNLPNFFRLVLQSSAVTIDDMEFFAEEIERLGCDL

SEQ ID NO: 191 - protein, 581 aa, Lottia gigantea
METKRFDNMSINDEATKEQFNELKQRLLEGKSLKSKQVSKVMIDVDSESEDSALSLQDSSANTDESDPDESNVETCTTQLQHSQRVNSRRKSTKAKFLTIPQVHHDDFLSDTFDLIMKEIVQKAGDRSQKVVEWKAPEELRELMDLDPTAVGETHEKLLMRLQDIIKYSVKTGHPRFVNQLFSSLDPYGLAGQIVTDALNTSQYTYETAPVFTLMEETVLKTMRTCIGYTEGNGIFCPGGSLSNIMAVNCARHFMFPQTKKTGMFGLPPLVIYTSELAHYSIKKAGYLLGFGDDNVKLVKTDELGKIIPEDLERQIQETIDEGCTPFMIVATAGTTVFGAFDPIDKMADVAQKYGLWYHVDGAWGGGVLMSKKHRDMMKGVDRADSVTWNPHKLLGVPQQCSCFLTKHVNILQQCHRADAKYLFQKDKFYDTSYDTGDKTFQCGRKVDVLKFWLMWKAKGSEGFEQHIDKLFDNTRYIVEKLKQREGFRMVVNEPDCTNVCFWYVPPSLRNMPEDEEFWNRLHTVAPKVKEGMIRDGTMMITYQPQKDLVNFFRLVLQNSATTYEDMDFFIDEIERLGKFL

SEQ ID NO: 192 - protein, 538 aa, Branchiostoma floridae
MSNILTSLEDSSFSCSCAKEMINGGIDGHLNDCSVRNLKSSLNDDTANVKAPKKDPLPKDEEDFLKAVFQVILEDGVRKGRDITQKVVDFHQPDELRTLLDLEIRDTPEDHQALIKHMKDTVKYSVRTSHPRFFNQLFSGQNTYALAGQWLTETLNTSQYTFEVAPVFTIMENVVLHKMRDIVGYSGGDGIFCPGGSISNLYALNVARYRYMPDIKKTGLFGLPRLVVFTSKQSHYSIKKAASVLGIGTNNVVLVDCDERGKMIASDLEAQILRVKAEGAVPFFVNCTSGTTVLGAYDPLDEVSDICEKHGLWMHVDAAWGGGVMMSPKYRASRMRGVERSDSITWNPHKMMGAGQQCSAFLLKHENLLQHCHEAKAKYLFQQDKFYDVSYDTGDKSIQCGRKVDVFKLWLMWKAKGSQGFHQDMDAIFDKTRYLVEKVKAREGFKMVLDEPECSNVCFWYIPPSLRGKEDEADYKDKLHQVAPRIKERMVLSGTMLVGYQPLGNKPNFFRQVFSSPSVTEEDLDFLLDEIERLGEDL

SEQ ID NO: 193 - protein, 335 aa, Meligethes aeneus
KEMRQIVGFKNGDGDGIFCPGGSMANGYAISCARYKFMPEIKQKGLHALPRLVLFTSRDAHYSIKKLSSFLGIGTDNVYAINTDEKGKMDMKHLEEEVERSIKEGGAPFMVSATSGTTVIGAFDPLEKIHEICQKYGMWMHVDAAWGGGALMSKKHRYLLKGIEKADSVTWNPHKLLTAPQQCSTLLLKQDGILSAMNSANATYLFQKDKFYDTKYDIGDKHIQCGRRPDVIKFWFMWKAKGTSGFEQHIDKVFENAKFFTDTIREREGFEMVIPEPECTNICFWYVPPSLRNRKSDPDYQDKLHKVAPKIKEKMMREGTMMVTYQPLRETPNFF

SEQ ID NO: 194 - protein, 401 aa, Solenopsis invicta
STSGEDRVVEWVDPYELRSVVDLSLPAEGVSHEELLKLTRDVIKYSVKTGHPHFVNQLFSSLDPYGLLGQWLTDALNPSVYTYEVSPVFSLMEEDVLREMRSIIGWHNGEGLFCPGGSMANGYAINLARHHRYPHLKQTGLSQMPRLVVFTSEDAHYSVKKLAAFLGIGYDNVYLAKVDSRGKMVVSDLEAQIARAIEEGAAPLMVSATAGTTVIGAFDPLKDIAEVCKKYGLWFHVDAAWGGGALVSAAYRGLLDGLHLADSVTWNPHKLLAAPQQCSTLLLRHKGLLQAAHGCGASYLFQNDKFYDASFDCGDRHVQCGRRADVVKFWYMWKAKGTRGLEAHVDRVFALSRYFADLIRAREGWHLLVEPECTNVCFRYVPPSKRHLAGQELDQVLHKVS

SEQ ID NO: 195 - protein, 555 aa, Crassostrea gigas
MASCMTESFKVHSCAHKRIHDKNDFEVEPTEKQRITMLSDKPVRKSNKENSMCNVTIKTKESHSENHKKHEKKAPKQEKAKHEFLDKLYEMMIKDGFMKARDRNEKVVEFSYPEELKQKIDFDLGSKTSDEKILSLCQDIIKYSVKVAHPRFFNQLYGGLDEYSLGGCWLTETMNASLYTYEVSPVFSLMERVVIDKMLGKIGFEDGDAMFCPGGSISNMYALNIARYFKYPEVKKKGIKGIPDICAFTSEKCHYSIGKGVAFMGMGLDNLINVKTDANGKMIPEDLEKKILEAKAEGKTPYFVNATAGTTVFGAFDPIDEIADICQKYNLWMHVDGAWGGGALLSKTYSPLLKGVERADSMTWNPHKLMGVPQQCSLVFTKHKGLLEQCHSANASYLFQQDKFYDVSYDTGDKSIQCGRKNDVLKLWIMWKNKGDEGFERDIDNQFECAKYLAQLVQEREGFELMLEPQCTNVCFYYIPKRLRGLERTPEWWNEISKVGPKVKEGMMKAGSMMVGYQPDGDFVNFFRMIISNLDTVKSDMDFVVDEIDRLGKDL

SEQ ID NO: 196 - DNA, 1020 bp, Candida parapsilosis
atggttaactacggcttcgttggtttgggtcagatgggtcaacacatggctagacacatctacaaccaattggaagtcgacgacaagttgtacgtttacgacaccgttccaactgccgttgaccaattcgtttcaaacgttacccagcaaaacgctaccaacaaggagaagttggttaccttgccagacttgaagtccttcgttaccggtgttgacggtcaattggacttcatcgtcaccatggttccagagggtaagcacgtcaagggtgttgttgaggacatcgttacctctttcgaacaaaacggttactccccagactacaacactaccatcatcgactcctccaccatcgacatcccaacctccagacaggttcacgaatacgttaaggaaaccttgcctcaattcgacttcatcgacgcacctgtttccggtggtgttgctggtgccagaaagggcaccttgtccttcatgttgtccagagaaacccaccaagacgtctctccagccttgactaccttgttgaacaagatgggtaagaacatcttcccatgtggtgctacccacggcaccggtttggctgctaagttgtccaacaactacttgttggctgtcaccaacatcgcagttgcagactccttccaattggcaaaggcattcggtttgaacttgcaaaactacgctaagttggttgcagtttccaccggcaagtcttgggcttctgttgacaactgcccaatccctggtgtttacccagaaaacaacttgcctgcagacgttggttaccaaggtggtttcatcaccaagttgaccagaaaggacgttgttttggctaccgactgcgccaaggaccaaggtagattcttgttcttgggtgacgcaggtagatactggtacgacaaggcgtgtgaaagagaagacatcgccaacagagacttggcagttttgtacgaatggttgggtgacttgaagcaagaagcagacggcaccgttgtcgacaccaaggtttccaagtaa

SEQ ID NO: 197 - protein, 339 aa, Candida parapsilosis
MVNYGFVGLGQMGQHMARHIYNQLEVDDKLYVYDTVPTAVDQFVSNVTQQNATNKEKLVTLPDLKSFVTGVDGQLDFIVTMVPEGKHVKGVVEDIVTSFEQNGYSPDYNTTIIDSSTIDIPTSRQVHEYVKETLPQFDFIDAPVSGGVAGARKGTLSFMLSRETHQDVSPALTTLLNKMGKNIFPCGATHGTGLAAKLSNNYLLAVTNIAVADSFQLAKAFGLNLQNYAKLVAVSTGKSWASVDNCPIPGVYPENNLPADVGYQGGFITKLTRKDVVLATDCAKDQGRFLFLGDAGRYWYDKACEREDIANRDLAVLYEWLGDLKQEADGTVVDTKVSK

SEQ ID NO: 198 - DNA, 996 bp, Debaryomyces hansenii
atgaccaactacggcttcatcggtttgggtgaaatgggtcaacacatgggtagacacatctacaacaagttggagccagacgacaagttgtacgtttacgacttggaaccagcaaacaccaagaagttcgtcgacaccgttaccgaagcatcccctgcaaacaagaagttggtcgttccattggaatccatctccgacttcgttcacaaggtcgactcccaattggagttcatcatgaccatggttccagaaggtaagcacgtcaagtccgttgtcgaagagttggtccagaactacaagaagtgtgctaccgacatctccggtgtctccactaccttcttggactcctccaccgtcgacatcccaacctccatcgaagtccacaagtacgtcaagcaacaaatcccagacttcgacttcatcgacaccccagtttccggtggtgttgccggtgccagaaagggcaccttgtccttcatgttgtccagagagacccacgaagacatgtccccatccttgacctccttgttgtccaagatgggcaccaacatcttcccatgtggtaagaaccacggcaccggtttggcagcaaagttgtccaacaactacttgttggctgtcaccaacttggcggtcgcagactccttccaattggcaaagtccttcggtttggacatgaagaactacgctaagttggtctccgtttccaccggtaagtcctgggcttccgttgacaactgtccaatcaaaggcgcttacccaaaggaaaacgacttgccagcagacagagactgccacggtggtttcatcaccaagttggctagaaaggacttggtcttggctacccaatccgcaaagtccaacaacagattcttgttcttgggtgaagtcggtaagaagtggtacgacaaggcttgtgaaagagaagacttggcaaccaaggacttgtccgtcttgtacgaatggttggaagaattgtccgaaaaggacaagtaa

SEQ ID NO: 199 - protein, 331 aa, Debaryomyces hansenii
MTNYGFIGLGEMGQHMGRHIYNKLEPDDKLYVYDLEPANTKKFVDTVTEASPANKKLVVPLESISDFVHKVDSQLEFIMTMVPEGKHVKSVVEELVQNYKKCATDISGVSTTFLDSSTVDIPTSIEVHKYVKQQIPDFDFIDTPVSGGVAGARKGTLSFMLSRETHEDMSPSLTSLLSKMGTNIFPCGKNHGTGLAAKLSNNYLLAVTNLAVADSFQLAKSFGLDMKNYAKLVSVSTGKSWASVDNCPIKGAYPKENDLPADRDCHGGFITKLARKDLVLATQSAKSNNRFLFLGEVGKKWYDKACEREDLATKDLSVLYEWLEELSEKDK

SEQ ID NO: 200 - DNA, 1017 bp, Meyerozyma guilliermondii
atggcaaactacggtttcatcggtttgggtcaaatgggccaacacatggcgagacacatctacaaccaattggaaccaaacgactccttgtacgtccacgacgtctccagagacgcaaccgagaccttcgttaacaccgtcacctccgcttccccagacagaaaggactgtttgaaggcattgtacaacatctccgacttcgttaccggtgttaacgctcaattggactacatcatcaccatggttcctgaaggtagacacgttaagggtgttgttcaacagttgatcgaaacctaccaacaaggtgcaccatccactaccaagactaccatcttggactcatctaccatcgacatcccaacctcaatcgaagttcacaactacgtcaagcagcaaatcccagaattcgacttcatcgacaccccagtcagtggtggcgttgctggtgccagaaagggcaccttgtccttcatgttgtccagaccaaccgacgaatccatctctccttctttgaacaccttgttgaagaagatgggtaagaacatcttcccatgtggtgcaaaccacggtgcaggtttagccgctaagttgtccaacaactacttgttggcagttaccaacttggcggttgccgactccttcagattggctcactccttcggtttggacttggtcaagtactccaagttggttgctgtttccaccggcaagtgttgggctgcagttgacaactgcccaatcccaggtgtctacccagccgagtacagattgccagtcgacgacggttacaacggtggtttcatcaccaagttgaccaagaaggacttggttttggctaccgacgctgctaagttcaacgaccgtttcttgttcatgggtgacgtttccagacactggtacgaaaaggcttgtgaaagagaagacatcgcttccagagacttggcagttttgtacgaatggttgggtgacatggaacaacaagcagacggcaccatcgtcgacaagaaggacgtctaa

SEQ ID NO: 201 - protein, 338 aa, Meyerozyma guilliermondii
MANYGFIGLGQMGQHMARHIYNQLEPNDSLYVHDVSRDATETFVNTVTSASPDRKDCLKALYNISDFVTGVNAQLDYIITMVPEGRHVKGVVQQLIETYQQGAPSTTKTTILDSSTIDIPTSIEVHNYVKQQIPEFDFIDTPVSGGVAGARKGTLSFMLSRPTDESISPSLNTLLKKMGKNIFPCGANHGAGLAAKLSNNYLLAVTNLAVADSFRLAHSFGLDLVKYSKLVAVSTGKCWAAVDNCPIPGVYPAEYRLPVDDGYNGGFITKLTKKDLVLATDAAKFNDRFLFMGDVSRHWYEKACEREDIASRDLAVLYEWLGDMEQQADGTIVDKKDV

SEQ ID NO: 202 - DNA, 1023 bp, Clavispora lusitaniae
atgaagaacttcggcttcatcggtttgggtcaaatgggtcagcacatggctagacacatctacaaccaattggaacctcaagacaccttgtacgtttacgacgcagtcccatccgcaaccgacgcgttcgtcgaaaagaactccaccccagaaaaggcttctcaattggtcccattgaagtccttgtcctccttcgttaccgacgttgactcccaattggacttcatcatcaccatggtcccagaaggtaagcacgtcaaggctgtcatccaagacttggtttcctcctaccaaaagcaaccatccttgcaaccaatgaccttcttggactcctccaccatcgacatctccacctccagagaagttcacgaattcgttaagtccaccatcccatccttcgacttcatcgacaccccagtctctggtggcgttgctggcgctagaaaggcctccttgtccttcatgttgtcccgtgaaaccatcgaagacgtctcccctgctttgacctccttgttgaacaagatgggtaagaacatcttcgcatgcggtccttcccacggttccggcttggcagcaaagttggcaaacaactacttgttggctgtcaccaacttggctgttgcagactccttccaattggcaaacaccttcaacttgaacttgcaacaatacgctaagttggttgctgtttccaccggtaagtcctgggcatccgttgacaactgtccaatcgctggtgcttacccaaaggagtacaacttgccagcagactccggttacgaaggtggtttcatcaccaagttgaccaagaaggacttggttttggcgaccgactgtgctgcggaatacaacagattcttgttcttgggcgacatctccagaaagtggtacttgaaggcatgtgagagagaagacttgggttccagagacttgggcgttttgttcgaatggttgggtcaaatcgaagaaagaaacggtgaagttgttgacaccaagacctccgaaccattgaagatcaactaa

SEQ ID NO: 203 - protein, 340 aa, Clavispora lusitaniae
MKNFGFIGLGQMGQHMARHIYNQLEPQDTLYVYDAVPSATDAFVEKNSTPEKASQLVPLKSLSSFVTDVDSQLDFIITMVPEGKHVKAVIQDLVSSYQKQPSLQPMTFLDSSTIDISTSREVHEFVKSTIPSFDFIDTPVSGGVAGARKASLSFMLSRETIEDVSPALTSLLNKMGKNIFACGPSHGSGLAAKLANNYLLAVTNLAVADSFQLANTFNLNLQQYAKLVAVSTGKSWASVDNCPIAGAYPKEYNLPADSGYEGGFITKLTKKDLVLATDCAAEYNRFLFLGDISRKWYLKACEREDLGSRDLGVLFEWLGQIEERNGEVVDTKTSEPLKIN

SEQ ID NO: 204 - DNA, 1035 bp, Issatchenkia orientalis
atgagtaagccaaaagtcttgttgattggattcggtggtgttggaaccattgtatcttacactttggagcaccttggccgtgccgaggtctctgcagtttcacgcccagagacccatgactctatagtaaatggatttcgtatcgagtccattgactatggtatcgttgagaactatgttccgaccaacgtttatgtcacagcaaaagaagcttacaaacaacaaggcccatttgattatatcattatcaccacaaagaatatccctgatattgcaccagttgttgatatgattgatgggtgctacaacgagaaatccgttattgtgttgattcaaaatggcattgggattgaaattccaatttataggagatatccaaacgcaattatattaagtggggtcacgttgattggcacaacgttgtacgaagctacagtcaagcatgtcgcaagggatgatatcaagtttgggccttttatcaactataacttggataaacagctgcagattaacaagtgtaaggaatttattgaactttatgaaaacgacaaaaacttggttgaatatgaggaagatgtcaagtttaccagatggaggaaactcgtctacaatgcctgtatcaatacaacctgtgcgctagctaatctagatgcaggtagagtgcagatatttggcggattcgagaccctcgtcaaacctgccatgttggaagtcattgcggttgctaaaagtgagggtgttgaattaccagcaaaggaagtgatggataccatgtgcaatatgggcaaagatgtctactatccaccttccatgttgattgatgttcggaacggcacgtacctggaacatattgtcatcattggcaatgttgtcaaatatgggtcccgtaatggtgttccaattccaacattgacggtgttgaacaacttgttgaagctcgtccaaatgagaacaatggaagccaataagaggtttgtcttgccagagaagaggccacttccagaggaaaactaccagattgaatacctctattga

SEQ ID NO: 205 - protein, 344 aa, Issatchenkia orientalis
MSKPKVLLIGFGGVGTIVSYTLEHLGRAEVSAVSRPETHDSIVNGFRIESIDYGIVENYVPTNVYVTAKEAYKQQGPFDYIIITTKNIPDIAPVVDMIDGCYNEKSVIVLIQNGIGIEIPIYRRYPNAIILSGVTLIGTTLYEATVKHVARDDIKFGPFINYNLDKQLQINKCKEFIELYENDKNLVEYEEDVKFTRWRKLVYNACINTTCALANLDAGRVQIFGGFETLVKPAMLEVIAVAKSEGVELPAKEVMDTMCNMGKDVYYPPSMLIDVRNGTYLEHIVIIGNVVKYGSRNGVPIPTLTVLNNLLKLVQMRTMEANKRFVLPEKRPLPEENYQIEYLY

SEQ ID NO: 206 - DNA, 1020 bp, Issatchenkia orientalis
caacttggttcaaaccaagaaagccgtcgtgtactttgcgtattttcaacttcttcccttcaactccaaccttataacccaatccgacagttagcatacagtagaaaatccataagttaattgcaaaaaccacataattcccaatgactggcacaatttgcatgaacggcgcaaaaccaacacctatccttcttgacttgtggacaacttctccggcatcggctccagtttctggtttaggcgacactttcaaggtacccttgttgactaggttctcagcaacatactcctcctcgataactttgaccgtctttgtgccaaacacattgttcaatagtttggacgctcgcataccgaagacagactcgtccatccaatagcatgtactccgaatgctctcaatcaacggtatcaaatcgcttggtgtctttggaggcggtgttctaggtttcatcttcgccttcccgtttcctgtttcttggacttcaaaatacgggtcatatgcatcttcattggtgaacctgaacagtttgggccgagtagtgccaaacaccttcaacagtataatcttcactccttggccgattagaaacatgcttatatgtttgccggtattcttaaagtgtatactggagcccttttaatcacattttttttacttgtcagtctccatacggagtttaatgtccttatatcgatcttcatcagctccaacgggacaggaatcaataaccttccttgcctgtcccaaaaagaatgaattttttttcaaaagctttacgatgcataccacaaaaggaagattattcccacatgttccagaagtgtgcggagatacaaagggttcatgaaaacgtgaatcttctaaaaacttagcacaacaataaaaatctacaatgttacagtaagtattattttctttttgtcgacacactccaacggttagatttccaagtattcaatccaatgtattacttgtcagacagccatccactcccatcttagaacatcacttccgaa

SEQ ID NO: 207 - DNA, 20 bp, Issatchenkia orientalis
gatatgggcggtagagaaga

SEQ ID NO: 208 - DNA, 20 bp, Issatchenkia orientalis
gctccttcaaaggcaacaca

SEQ ID NO: 209 - DNA, 53 bp, Issatchenkia orientalis
gtaaaacgacggccagtgagttcgttaacggtagagtctctccttctggttcg

SEQ ID NO: 210 - DNA, 66 bp, Issatchenkia orientalis
aaaaataaactagtaaaataaattaattaacatgcggccgcaagtgtgagagaaggagaaagaccg

SEQ ID NO: 211 - DNA, 66 bp, Issatchenkia orientalis
ctggagaatagatcttcaacgcgtttaaactgtgcggccgcctgaagtgccattcccatcacatgg

SEQ ID NO: 212 - DNA, 51 bp, Issatchenkia orientalis
gaccatgattacgccaagctccgcggtagcggggaagatattttttgaata

SEQ ID NO: 213 - DNA, 27 bp, Issatchenkia orientalis
ccacaagccacaatgatgataaatggg

SEQ ID NO: 214 - DNA, 24 bp, Issatchenkia orientalis
gttgtagagtgtatgcggcaatgg

SEQ ID NO: 215 - DNA, 26 bp, Issatchenkia orientalis
gttgaacaacttgttgaagctcgtcc

SEQ ID NO: 216 - DNA, 20 bp, Issatchenkia orientalis
tcggcacggccaaggtgctc

What is claimed is:

1. A recombinant yeast cell, wherein the recombinant yeast cell belongs to the genus *Issatchenkia*, wherein the recombinant yeast cell comprises (1) an active 3-hydroxypropionic acid (3-HP) pathway capable of producing 3-HP and (2) a disruption to an endogenous gene that encodes a pyruvate reductase, and wherein the amino acid sequence of the pyruvate reductase has at least 95% sequence identity to the amino acid sequence of SEQ ID NO: 205.

2. The recombinant cell of claim 1, wherein the amino acid sequence of the pyruvate reductase differs by no more than ten amino acids from the amino acid sequence of SEQ ID NO: 205.

3. The recombinant cell of claim 1, wherein the pyruvate reductase comprises or consists of the amino acid sequence of SEQ ID NO: 205.

4. The recombinant cell of claim 1, wherein the cell produces less D-lactate compared to a corresponding yeast cell that lacks disruption of the endogenous gene encoding the pyruvate reductase, when cultivated under identical conditions.

5. The recombinant cell of claim 1, wherein the cell produces less pyruvate reductase compared to a corresponding yeast cell that lacks disruption of the endogenous gene encoding the pyruvate reductase, when cultivated under identical conditions.

6. The recombinant cell of claim 1, wherein the endogenous gene encoding the pyruvate reductase is inactivated.

7. The recombinant cell of claim 1, wherein the cell comprises one or more heterologous polynucleotides selected from:
   a heterologous polynucleotide encoding a pyruvate dehydrogenase (PDH);
   a heterologous polynucleotide encoding an acetyl-CoA carboxylase (ACC);
   a heterologous polynucleotide encoding a malonyl-CoA reductase; and
   a heterologous polynucleotide encoding a 3-HP dehydrogenase (3-HPDH).

8. The recombinant cell of claim 1, wherein the cell comprises one or more heterologous polynucleotides selected from:
   a heterologous polynucleotide encoding a PEP carboxylase (PPC);
   a heterologous polynucleotide encoding a pyruvate carboxylase (PYC);
   a heterologous polynucleotide encoding an aspartate aminotransferase (AAT);
   a heterologous polynucleotide encoding an aspartate 1-decarboxylase (ADC);
   a heterologous polynucleotide encoding a β-alanine aminotransferase (BAAT) or aminobutyrate aminotransferase (gabT); and
   a heterologous polynucleotide encoding a 3-HP dehydrogenase (3-HPDH).

9. The recombinant cell of claim 1, wherein the cell is an *Issatchenkia orientalis*.

10. The recombinant cell of claim 1, wherein the yeast cell is unable to ferment pentose sugars.

11. A method of producing 3-hydroxypropionic acid (3-HP), comprising:
    (a) cultivating the recombinant yeast cell of claim 1 in a fermentable medium under suitable conditions to produce 3-HP; and
    (b) recovering the 3-HP.

12. A method of producing acrylic acid or a salt thereof, comprising:
  (a) cultivating the recombinant cell of claim 1 in a fermentable medium under suitable conditions to produce 3-hydroxypropionic acid (3-HP);
  (b) recovering the 3-HP;
  (c) dehydrating the 3-HP under suitable conditions to produce acrylic acid or a salt thereof; and
  (d) recovering the acrylic acid or salt thereof.

13. The method of claim 11, wherein the fermentable medium comprises less than 1% pentose sugars.

14. A method for obtaining the recombinant yeast cell of claim 1, comprising:
  (a) cultivating a parent yeast strain, wherein the parent strain belongs to the genus *Issatchenkia;*
  (b)(i) transforming the parent strain with one or more 3-hydroxypropionic acid (3-HP) pathway gene(s) to provide an active 3-HP pathway in the parent strain of (a);
  (b)(ii) disrupting an endogenous gene encoding a pyruvate reductase in the parent strain of (a), wherein the amino acid sequence of the pyruvate reductase has at least 95% sequence identity to the amino acid sequence of SEQ ID NO: 205; and
  (c) isolating the recombinant yeast cell resulting from (b)(i) and (b)(ii).

15. The recombinant cell of claim 1, wherein the amino acid sequence of the pyruvate reductase has at least 97% sequence identity to the amino acid sequence of SEQ ID NO: 205.

16. The method of claim 11, wherein the amino acid sequence of the pyruvate reductase has at least 97% sequence identity to the amino acid sequence of SEQ ID NO: 205.

17. The method of claim 11, wherein the amino acid sequence of the pyruvate reductase comprises or consists of the amino acid sequence of SEQ ID NO: 205.

18. The method of claim 11, wherein the recombinant cell is an *Issatchenkia orientalis* cell.

* * * * *